US007390882B2

(12) United States Patent
Cairns et al.

(10) Patent No.: US 7,390,882 B2
(45) Date of Patent: Jun. 24, 2008

(54) COMPOSITIONS AND METHODS FOR THE DIAGNOSIS AND TREATMENT OF TUMOR

(75) Inventors: Belinda Cairns, Burlingame, CA (US); Gretchen Frantz, San Francisco, CA (US); Hartmut Koeppen, Berkeley, CA (US); Paul Polakis, Burlingame, CA (US); Thomas D. Wu, San Francisco, CA (US); Zemin Zhang, Foster City, CA (US)

(73) Assignee: Genentech, Inc., South San Francisco, CA (US)

( * ) Notice: Subject to any disclaimer, the term of this patent is extended or adjusted under 35 U.S.C. 154(b) by 27 days.

(21) Appl. No.: 11/248,718

(22) Filed: Oct. 11, 2005

(65) Prior Publication Data

US 2006/0160997 A1 Jul. 20, 2006

Related U.S. Application Data

(63) Continuation of application No. 10/177,488, filed on Jun. 19, 2002, now abandoned.

(60) Provisional application No. 60/299,500, filed on Jun. 20, 2001, provisional application No. 60/300,880, filed on Jun. 25, 2001, provisional application No. 60/301,880, filed on Jun. 29, 2001, provisional application No. 60/304,813, filed on Jul. 11, 2001, provisional application No. 60/312,312, filed on Aug. 13, 2001, provisional application No. 60/314,280, filed on Aug. 22, 2001, provisional application No. 60/339,227, filed on Oct. 19, 2001, provisional application No. 60/323,268, filed on Sep. 18, 2001, provisional application No. 60/336,827, filed on Nov. 7, 2001, provisional application No. 60/378,885, filed on May 8, 2002, provisional application No. 60/366,869, filed on Mar. 20, 2002.

(51) Int. Cl.
    *C07K 1/00* (2006.01)
(52) U.S. Cl. .................................. 530/350
(58) Field of Classification Search ............ None
    See application file for complete search history.

(56) References Cited

U.S. PATENT DOCUMENTS

2004/0063120 A1* 4/2004 Beer et al. ............... 435/6
2005/0107595 A1  5/2005 Cairns et al.

FOREIGN PATENT DOCUMENTS

| EP | 0 875 569 A1 | 11/1998 |
|---|---|---|
| EP | 1 111 048 A2 | 6/2001 |
| WO | WO 99/33869 | 7/1999 |
| WO | WO 00/15666 | 3/2000 |
| WO | WO 01/18046 | 3/2001 |
| WO | WO01/94629 | 12/2001 |
| WO | WO02/064798 | 8/2002 |
| WO | 03/000113 | 1/2003 |
| WO | WO03/043631 | 5/2003 |
| WO | WO2005/107595 | 11/2005 |
| WO | 2005/117986 A2 | 12/2005 |
| WO | WO2006/010496 | 2/2006 |

OTHER PUBLICATIONS

Greenbaum et al., Genome Biology, 2003, vol. 4 (9), pp. 117.1-117.8.*
Mallampalli et al., Biochem. J. 1996, vol. 38, pp. 333-341.*
Bowie, et al. Science, vol. 247: 1306-1310, 1990.*
Lazar, et al. Mol. Cell. Biol., 8(3): 1247-1252, 1988.*
Burgess, et al. J. Cell Biol. 111: 2129-2138, 1990.*
Ngo et al., in"The Protein Folding Problem and Tediary Structure Prediction", 1994, Merz, et al. (ed.), Birkhauser, Boston, MA, pp. 433, and 492-495.*
Skolnick et al., From genes to protein structure an function: novel applications of computational approaches in the genomic era, Trends in Biotech. 18: 34-39, 2000.*
Alberts, et al *Molecular Biology of the Cell*, 3rd edition edition pp. 465 (1994).
"Blast Results A-1-A-248".
"Blast Results B-1-B-17".
Fu et al *EMBO Journal* 15:4392-4401 (1996).
Hanash S., "Integrated global profiling of cancer" *Nature Reviews, Applied Proteomics Collection* pp. 9-14 (Mar. 2005).
Hu, et al. *Journal of Proteome Research* 2:405-412 (2003).
Powell et al., "Expression of cytochrome P4502E1 in human liver: assessment by mRNA, genotype and phenotype" *Pharmacogenesis* (abstract) 8(5) :411-421 (Oct. 1998).
Vallejo et al., "Evidence of tissue-specific, post-transcriptional regulation of NRF-2 expression" *Biochimie* (abstract) 82 (12) :1129-1133 (Dec. 2000).
Doronina et al., "Development of potent monoclonal antibody auristatin conjugates for cancer therapy" *Nature Biotechnology* 21:778-784 (2003).
Doronina, S., et al., "Immunoconjugates Comprised of Drugs with Impaired Cellular Permeability: A New Approach to Targeted Therapy" *Abstracts of Papers American Chemical Society* 228 (Part 1) :U908 (Aug. 2004).
Henderson, M., et al., "Microfibril-associated Glycoprotein-1 (MAGP-1) Is Specifically Located on the Beads of the Beaded-filament Structure for Fibrillin-containing Microfibrils as Visualized by the Rotary Shadowing Technique" *The J. of Histochemistry and Cytochemistry* 44 (12) :1389-97 (1996).
Mannion, B., et al., "The Light Chain of CD98 Is Identified as E16/TA1 Protein" *The J. of Biological Chemistry* 273 (50) :33127-29 (Dec. 11, 1998).

(Continued)

Primary Examiner—Christopher Yaen
Assistant Examiner—Hong Sang
(74) Attorney, Agent, or Firm—Mark T. Kresnak; Ginger R. Dreger; Goodwin Procter LLP

(57) ABSTRACT

The present invention is directed to compositions of matter useful for the diagnosis and treatment of tumor in mammals and to methods of using those compositions of matter for the same.

3 Claims, 162 Drawing Sheets

OTHER PUBLICATIONS

Blast Report Assession No. AX775590. Record created Jul. 9, 2003.
Blast Report Assession No. BC017023. Record created Jul. 15, 2006.
Blast Report Assession No. BT006664. Record created May 13, 2003.
Blast Report Assession No. DD106754. Record created Nov. 4, 2005.
Burger, A M et al., "Identification and characterization of prostein, a novel prostate-specific protein", Cancer Research, American Association for Cancer Research, Baltimore, MS, US, vol. 61, No. 4 (Feb. 15, 2001), pp. 1563-1568 XP002262454 ISSN: 0008-5472.
Lopez, M et al., "Nectin2alpha (PRR2alpha or HveB) and Nectin2delta are low-efficiency mediators for entry of herpes simplex virus mutants carrying the Leu25Pro substitution in glycoprotein D" Journal of Virology, The American Society for Microbiology, US, vol. 74, No. 3 (Feb. 2000) pp. 1267-1274, XP002301423 ISSN: 0022-538X.
Lopez, M et al., "The human poliovirus receptor related 2 protein is a new hematopoietic/endothelial homophilic adhesion molecule" Blood, W. B. Saunders Company, Orlando, FL, US., vol. 92, No. 12 (Dec. 15, 1998), pp. 4602-4611 XP002268761 ISSN: 0006-4971.
Warner, M S et al., "A cell surface protein with herpesvirus entry activity (HveB) confers susceptibility to infection by mutants of herpes simplex virus type 1, herpes simplex virus type 2, and pseudorabies virus" Virology, Academic Press, orlando, US. vol. 246, No. 1 (Jun. 20, 1998), pp. 179-189, XP004445786 ISSN: 0042-6822.
Xu, J et al., "Identification and characterization of prostein,a novel prostate-specific protein" Cancer Research, American Association for Cancer Research, Baltimore, MD, US, vol. 61, No. 4 (Feb. 15, 2001), pp. 1563-1568, XP002262454 ISSN: 0008-5472.
Fujimoto, N et al., "Expressing of microfibril-associated glycoprotein-1 (MAGP-1) in human epidermal keratinocytes", Archives of Dermatological Research, vol. 292, No. 1 (Jan. 2000) pp. 21-26 XP002436049 ISSN: 0340-3696.
Zebda, N et al., "Expression of PNA-binding sites on specific glycoproteins by human melanoma cells is associated with a high metastatic peotential", Journal of Cellular Biochemistry, vol. 54, No. 2 (1994) pp. 161-173 XP002436050 ISSN: 0730-2312.
Decision by the Board of Patent Appeals and Interferences (Decision on Appeal No. 2006-1469).
Villa, R., et al., "The Methly-CpG Binding Protein MBD1 is Required for PML-RARα Function," *PNAS*—103(5):1400-1405 (2006).
Sequence Alignment Report Between SEQ ID No. 108 and Human DEDE-1.

* cited by examiner

FIGURE 1

CCAAGAATTCGGCACGAGGGTGACCCGGACAGCTGTCCTCTCTGACACCACCCCGGCCTGCCTCTTTGTTGCCA
TGAGAGCTGCCTACCTCTTCCTGCTATTCCTGCCTGCAGGCTTGCTGGCTCAGGGCCAGTATGACCTGGACCCG
CTGCCGCCGTTCCCTGACCACGTCCAGTACACCCACTATAGCGACCAGATCGACAACCCAGACTACTATGATTA
TCAAGAGGTGACTCCTCGGCCCTCCGAGGAACAGTTCCAGTTCCAGTCCCAGCAGCAAGTCCAACAGGAAGTCA
TCCCAGCCCCAACCCCAGAACCAGGAAATGCAGAGCTGGAGCCCACAGAGCCTGGGCCTCTTGACTGCCGTGAG
GAACAGTACCCGTGCACCCGCCTCTACTCCATACACAGGCCTTGCAAACAGTGTCTCAACGAGGTCTGCTTCTA
CAGCCTCCGCCGTGTGTACGTCATTAACAAGGAGATCTGTGTTCGTACAGTGTGTGCCCACGAGGAGCTCCTCC
GAGCTGACCTCTGTCGGGACAAGTTCTCCAAATGTGGCGTGATGGCCAGCAGCGGCCTGTGCCAATCCGTGGCG
GCCTCCTGTGCCAGGAGCTGTGGGAGCTGCTAGGGTGGTGCTGGCATCCTGAGTCCTGGCCCTCCTGGGATCTG
GGGCCCTCGGGCCCTGCCTGACCTGGTGCTTTTTTCCCCATCCCCATGTTCCTTTTATTCTGTAAAAAGTTAGT
GGACTGCAGCCCTGGGGGTTGCAGGCTGCGGTGCCTCAGGCCCCTCCTTCAGCCTGTGGCCACCTCTGGGGCAC
GATGGGGGCTCCCCACTGCCCAGTCTGCCCCTCGGGTTGGGGGAGTATCCCAGGCCTCTCTGTGGGACCTGGGC
CCCTGACGGGCCTTCTCAGCCCGTTTTGAGGACAGACAGTCCCCGAGGTAGGCTACATCCCCCCACCCCAGCT
GGTCTGCTTGGATTTCCTACAGCCCCGTGGGCATGGACCACCTTTATTTTATACAAAATTAAAAACAAGTTTTAC

FIGURE 2A

CACTAACGCTCTTCCTAGTCCCCGGGCCAACTCGGACAGTTTGCTCATTTATTGCAACGGTCAAGGCTGGCTTG
TGCCAGAACGGCGCGCGCGACGCACGCACACACACGGGGGGAAACTTTTTTAAAAATGAAAGGCTAGAAGAG
CTCAGCGGCGGCGCGGGCCGTGCGCGAGGGCTCCGGAGCTGACTCGCCGAGGCAGGAAATCCCTCCGGTCGCGA
CGCCCGGCCCCGCTCGGCGCCCGCGTGGGATGGTGCAGCGCTCGCCGCCGGGCCCGAGAGCTGCTGCACTGAAG
GCCGGCGAC<u>ATG</u>GCAGCGCGCCCGCTGCCCGTGTCCCCCGCCCGCGCCCTCCTGCTCGCCCTGGCCGGTGCTC
TGCTCGCGCCCTGCGAGGCCCGAGGGGTGAGCTTATGGAACGAAGGAAGAGCTGATGAAGTTGTCAGTGCCTCT
GTTCGGAGTGGGGACCTCTGGATCCCAGTGAAGAGCTTCGACTCCAAGAATCATCCAGAAGTGCTGAATATTCG
ACTACAACGGGAAAGCAAAGAACTGATCATAAATCTGGAAAGAAATGAAGGTCTCATTGCCAGCAGTTTCACGG
AAACCCACTATCTGCAAGACGGTACTGATGTCTCCCTCGCTCGAAATTACACGGTAATTCTGGGTCACTGTTAC
TACCATGGACATGTACGGGGATATTCTGATTCAGCAGTCAGTCTCAGCACGTGTTCTGGTCTCAGGGGACTTAT
TGTGTTTGAAAATGAAAGCTATGTCTTAGAACCAATGAAAGTGCAACCAACAGATACAAACTCTTCCCAGCGA
AGAAGCTGAAAAGCGTCCGGGGATCATGTGGATCACATCACAACACACCAAACCTCGCTGCAAAGAATGTGTTT
CCACCACCCTCTCAGACATGGGCAAGAAGGCATAAAAGAGAGACCCTCAAGGCAACTAAGTATGTGGAGCTGGT
GATCGTGGCAGACAACCGAGAGTTTCAGAGGCAAGGAAAAGATCTGGAAAAAGTTAAGCAGCGATTAATAGAGA
TTGCTAATCACGTTGACAAGTTTTACAGACCACTGAACATTCGGATCGTGTTGGTAGGCGTGGAAGTGTGGAAT
GACATGGACAAATGCTCTGTAAGTCAGGACCCATTCACCAGCCTCCATGAATTTCTGGACTGGAGGAAGATGAA
GCTTCTACCTCGCAAATCCCATGACAATGCGCAGCTTGTCAGTGGGGTTTATTTCCAAGGGACCACCATCGGCA
TGGCCCCAATCATGAGCATGTGCACGGCAGACCAGTCTGGGGGAATTGTCATGGACCATTCAGACAATCCCCTT
GGTGCAGCCGTGACCCTGGCACATGAGCTGGGCCACAATTTCGGGATGAATCATGACACACTGGACAGGGCTG
TAGCTGTCAAATGGCGGTTGAGAAAGGAGGCTGCATCATGAACGCTTCCACCGGGTACCCATTTCCCATGGTGT
TCAGCAGTTGCAGCAGGAAGGACTTGGAGACCAGCCTGGAGAAAGGAATGGGGGTGTGCCTGTTTAACCTGCCG
GAAGTCAGGGAGTCTTTCGGGGCCAGAAGTGTGGGAACAGATTTGTGGAAGAAGGAGAGGAGTGTGACTGTGG
GGAGCCAGAGGAATGTATGAATCGCTGCTGCAATGCCACCACCTGTACCCTGAAGCCGGACGCTGTGTGCGCAC
ATGGGCTGTGCTGTGAAGACTGCCAGCTGAAGCCTGCAGGAACAGCGTGCAGGGACTCCAGCAACTCCTGTGAC
CTCCCAGAGTTCTGCACAGGGGCCAGCCCTCACTGCCCAGCCAACGTGTACCTGCACGATGGGCACTCATGTCA
GGATGTGGACGGCTACTGCTACAATGGCATCTGCCAGACTCACGAGCAGCAGTGTGTCACACTCTGGGGACCAG
GTGCTAAACCTGCCCCTGGGATCTGCTTTGAGAGAGTCAATTCTGCAGGTGATCCTTATGGCAACTGTGGCAAA
GTCTCGAAGAGTTCCTTTGCCAAATGCGAGATGAGAGATGCTAAATGTGGAAAAATCCAGTGTCAAGGAGGTGC
CAGCCGGCCAGTCATTGGTACCAATGCCGTTTCCATAGAAACAAACATCCCCCTGCAGCAAGGAGGCCGGATTC
TGTGCCGGGGGACCCACGTGTACTTGGGCGATGACATGCCGGACCCAGGGCTTGTGCTTGCAGGCACAAAGTGT
GCAGATGGAAAAATCTGCCTGAATCGTCAATGTCAAAATATTAGTGTCTTTGGGGTTCACGAGTGTGCAATGCA
GTGCCACGGCAGAGGGGTGTGCAACAACAGGAAGAACTGCCACTGCGAGGCCCACTGGGCACCTCCCTTCTGTG
ACAAGTTTGGCTTTGGAGGAAGCACAGACAGCGGCCCCATCCGGCAAGCAGATAACCAAGGTTTAACCATAGGA
ATTCTGGTGACCATCCTGTGTCTTCTTGCTGCCGGATTTGTGGTTTATCTCAAAAGGAAGACCTTGATACGACT
GCTGTTTACAAATAAGAAGACCACCATTGAAAAACTAAGGTGTGTGCGCCCTTCCCGGCCACCCGTGGCTTCC
AACCCTGTCAGGCTCACCTCGGCCACCTTGGAAAAGGCCTGATGAGGAAGCCGCCAGATTCCTACCCACCGAAG
GACAATCCCAGGAGATTGCTGCAGTGTCAGAATGTTGACATCAGCAGACCCCTCAACGGCCTGAATGTCCCTCA
GCCCCAGTCAACTCAGCGAGTGCTTCCTCCCCTCCACCGGGCCCCACGTGCACCTAGCGTCCCTGCCAGACCCC
TGCCAGCCAAGCCTGCACTTAGGCAGGCCCAGGGGACCTGTAAGCCAAACCCCCTCAGAAGCCTCTGCCTGCA
GATCCTCTGGCCAGAACAACTCGGCTCACTCATGCCTTGGCCAGGACCCCAGGACAATGGGAGACTGGGCTCCG

FIGURE 2B

```
CCTGGCACCCCTCAGACCTGCTCCACAATATCCACACCAAGTGCCCAGATCCACCCACACCGCCTATATTAAGT
GAGAAGCCGACACCTTTTTTCAACAGTGAAGACAGAAGTTTGCACTATCTTTCAGCTCCAGTTGGAGTTTTTG
TACCAACTTTTAGGATTTTTTTTAATGTTTAAAACATCATTACTATAAGAACTTTGAGCTACTGCCGTCAGTGC
TGTGCTGTGCTATGGTGCTCTGTCTACTTGCACAGGTACTTGTAAATTATTAATTTATGCAGAATGTTGATTAC
AGTGCAGTGCGCTGTAGTAGGCATTTTTACCATCACTGAGTTTTCCATGGCAGGAAGGCTTGTTGTGCTTTTAG
TATTTTAGTGAACTTGAAATATCCTGCTTGATGGGATTCTGGACAGGATGTGTTTGCTTTCTGATCAAGGCCTT
ATTGGAAAGCAGTCCCCCAACTACCCCCAGCTGTGCTTATGGTACCAGATGCAGCTCAAGAGATCCCAAGTAGA
ATCTCAGTTGATTTTCTGGATTCCCCATCTCAGGCCAGAGCCAAGGGGCTTCAGGTCCAGGCTGTGTTTGGCTT
TCAGGGAGGCCCTGTGCCCCTTGACAACTGGCAGGCAGGCTCCCAGGGACACCTGGGAGAAATCTGGCTTCTGG
CCAGGAAGCTTTGGTGAGAACCTGGGTTGCAGACAGGAATCTTAAGGTGTAGCCACACCAGGATAGAGACTGGA
ACACTAGACAAGCCAGAACTTGACCCTGAGCTGACCAGCCGTGAGCATGTTTGGAAGGGGTCTGTAGTGTCACT
CAAGGCGGTGCTTGATAGAAATGCCAAGCACTTCTTTTTCTCGCTGTCCTTTCTAGAGCACTGCCACCAGTAGG
TTATTTAGCTTGGGAAAGGTGGTGTTTCTGTAAGAAACCTACTGCCCAGGCACTGCAAACCGCCACCTCCCTAT
ACTGCTTGGAGCTGAGCAAATCACCACAAACTGTAATACAATGATCCTGTATTCAGACAGATGAGGACTTTCCA
TGGGACCACAACTATTTTCAGATGTGAACCATTAACCAGATCTAGTCAATCAAGTCTGTTTACTGCAAGGTTCA
ACTTATTAACAATTAGGCAGACTCTTTATGCTTGCAAAAACTACAACCAATGGAATGTGATGTTCATGGGTATA
GTTCATGTCTGCTATCATTATTCGTAGATATTGGACAAAGAACCTTCTCTATGGGCATCCTCTTTTTCCAACT
TGGCTGCAGGAATCTTTAAAAGATGCTTTTAACAGAGTCTGAACCTATTTCTTAAACACTTGCAACCTACCTGT
TGAGCATCACAGAATGTGATAAGGAAATCAACTTGCTTATCAACTTCCTAAATATTATGAGATGTGGCTTGGGC
AGCATCCCCTTGAACTCTTCACTCTTCAAATGCCTGACTAGGGAGCCATGTTTCACAAGGTCTTTAAAGTGACT
AATGGCATGAGAAATACAAAAATACTCAGATAAGGTAAAATGCCATGATGCCTCTGTCTTCTGGACTGGTTTTC
ACATTAGAAGACAATTGACAACAGTTACATAATTCACTCTGAGTGTTTTATGAGAAAGCCTTCTTTTGGGGTCA
ACAGTTTTCCTATGCTTTGAAACAGAAAAATATGTACCAAGAATCTTGGTTTGCCTTCCAGAAAACAAAACTGC
ATTTCACTTTCCCGGTGTTCCCCACTGTATCTAGGCAACATAGTATTCATGACTATGGATAAACTAAACACGTG
ACACAAACACACACAAAAGGGAACCCAGCTCTAATACATTCCAACTCGTATAGCATGCATCTGTTTATTCTATA
GTTATTAAGTTCTTTAAAATGTAAAGCCATGCTGGAAAATAATACTGCTGAGATACATACAGAATTACTGTAAC
TGATTACACTTGGTAATTGTACTAAAGCCAAACATATATATACTATTAAAAGGTTTACAGAATTTTATGGTGC
ATTACGTGGGCATTGTCTTTTTAGATGCCCAAATCCTTAGATCTGGCATGTTAGCCCTTCCTCCAATTATAAGA
GGATATGAACCAAAAAAAAAAAAAAAAAAAA
```

FIGURE 3

GGAGTTTCAAAGAAGCGCTAGTAAGGTCTCTGAGATCCTTGCACTAGCTACATCCTCAGGGTAGGAGGAAGATG
GCTTCCAGAAGCATGCGGCTGCTCCTATTGCTGAGCTGCCTGGCCAAAACAGGAGTCCTGGGTGATATCATCAT
GAGACCCAGCTGTGCTCCTGGATGGTTTTACCACAAGTCCAATTGCTATGGTTACTTCAGGAAGCTGAGGAACT
GGTCTGATGCCGAGCTCGAGTGTCAGTCTTACGGAAACGGAGCCCACCTGGCATCTATCCTGAGTTTAAAGGAA
GCCAGCACCATAGCAGAGTACATAAGTGGCTATCAGAGAAGCCAGCCGATATGGATTGGCCTGCACGACCCACA
GAAGAGGCAGCAGTGGCAGTGGATTGATGGGGCCATGTATCTGTACAGATCCTGGTCTGGCAAGTCCATGGGTG
GGAACAAGCACTGTGCTGAGATTAGCTCCAATAACAACTTTTTAACTTGGAGCAGCAACGAATGCAACAAGCGC
CAACACTTCCTGTGCAAGTACCGACCATAGAGCAAGAATCAAGATTCTGCTAACTCCTGCACAGCCCCGTCCTC
TTCCTTTCTGCTAGCCTGGCTAAATCTGCTCATTATTTCAGAGGGGAAACCTAGCAAACTAAGAGTGATAAGGG
CCCTACTACACTGGCTTTTTTAGGCTTAGAGACAGAAACTTTAGCATTGGCCCAGTAGTGGCTTCTAGCTCTAA
ATGTTTGCCCCGCCATCCCTTTCCACAGTATCCTTCTTCCCTCCTCCCCTGTCTCTGGCTGTCTCGAGCAGTCT
AGAAGAGTGCATCTCCAGCCTATGAAACAGCTGGGTCTTTGGCCATAAGAAGTAAAGATTTGAAGACAGAAGGA
AGAAACTCAGGAGTAAGCTTCTAGACCCCTTCAGCTTCTACACCCTTCTGCCCTCTCTCCATTGCCTGCACCCC
ACCCCAGCCACTCAACTCCTGCTTGTTTTTCCTTTGGCCATAGGAAGGTTTACCAGTAGAATCCTTGCTAGGTT
GATGTGGGCCATACATTCCTTTAATAAACCATTGTGTACATAAAAAAAAAAAAAAAAAAAAAAAAAAAAAAAAA
AAAAAAAAAAAAAAAAAAAAAAAAAAAAAAAAAAAAAAAA

FIGURE 4

GGGGAGCAGAGAGGAGGCAATGGCCACCATGGAGAACAAGGTGATCTGCGCCCTGGTCCTGGTGTCCATGCTGG
CCCTCGGCACCCTGGCCGAGGCCCAGACAGAGACGTGTACAGTGGCCCCCCGTGAAAGACAGAATTGTGGTTTT
CCTGGTGTCACGCCCTCCCAGTGTGCAAATAAGGGCTGCTGTTTCGACGACACCGTTCGTGGGGTCCCCTGGTG
CTTCTATCCTAATACCATCGACGTCCCTCCAGAAGAGGAGTGTGAATTTTAGACACTTCTGCAGGGATCTGCCT
GCATCCTGACGCGGTGCCATCCCCAGCACGGTGATTAGTCCCAGAGCTCGGCTGCCACCTCCACCGGACACCTC
AGACACGCTTCTGCAGCTGTGCCTCGGCTCACAACACAGATTGACTGCTCTGACTTTGACTACTCAAAATTGGC
CTAAAAATTAAAAGAGCTCGATATTAAAAA

FIGURE 5

```
AATCCATCTGAGAATATGCTGCCACAAATACCCTTTTTGCTGCTAGTATCCTTGAACTTGGTTCATGGAGTGTTTTACGCTG
AACGATACCAAACGCCCACAGGCATAAAAGGCCCACTACCCAACACCAAGACACAGTTCTTCATTCCCTACACCATAAAGAG
TAAAGGTATAGCAGTAAGAGGAGAGCAAGGTACTCCTGGTCCACCAGGCCCTGCTGGACCTCGAGGGCACCCAGGTCCTTCT
GGACCACCAGGAAAACCAGGCTACGGAAGTCCTGGACTCCAAGGAGAGCCAGGGTTGCCAGGACCACCGGGACCATCAGCTG
TAGGGAAACCAGGTGTGCCAGGACTCCCAGGAAAACCAGGAGAGAGAGGACCATATGGACCAAAAGGAGATGTTGGACCAGC
TGGCCTACCAGGACCCCGGGGCCCACCAGGACCACCTGGAATCCCTGGACCGGCTGGAATTTCTGTGCCAGGAAAACCTGGA
CAACAGGGACCCACAGGAGCCCCAGGACCCAGGGGCTTTCCTGGAGAAAAGGGTGCACCAGGAGTCCCTGGTATGAATGGAC
AGAAAGGGGAAATGGGATATGGTGCTCCTGGTCGTCCAGGTGAGAGGGGTCTTCCAGGCCCTCAGGGTCCCACAGGACCATC
TGGCCCTCCTGGAGTGGGAAAAAGAGGTGAAAATGGGGTTCCAGGACAGCCAGGCATCAAAGGTGATAGAGGTTTTCCGGGA
GAAATGGGACCAATTGGCCCACCAGGTCCCCAAGGCCCTCCTGGGGAACGAGGGCCAGAAGGCATTGGAAAGCCAGGAGCTG
CTGGAGCCCCAGGCCAGCCAGGGATTCCAGGAACAAAAGGTCTCCCTGGGGCTCCAGGAATAGCTGGGCCCCAGGGCCTCC
TGGCTTTGGGAAACCAGGCTTGCCAGGCCTGAAGGGAGAAAGAGGACCTGCTGGCCTTCCTGGGGGTCCAGGTGCCAAGGG
GAACAAGGGCCAGCAGGTCTTCCTGGGAAGCCAGGTCTGACTGGACCCCCTGGGAATATGGGACCCCAAGGACCAAAAGGCA
TCCCGGGTAGCCATGGTCTCCCAGGCCCTAAAGGTGAGACAGGGCCAGCTGGGCCTGCAGGATACCCTGGGGCTAAGGGTGA
AAGGGGTTCCCCTGGGTCAGATGGAAAACCAGGGTACCCAGGAAAACCAGGTCTCGATGGTCCTAAGGGTAACCCAGGGTTA
CCAGGTCCAAAAGGTGATCCTGGAGTTGGAGGACCTCCTGGTCTCCCAGGCCCTGTGGGCCCAGCAGGAGCAAAGGGAATGC
CCGGACACAATGGAGAGGCTGGCCCAAGAGGTGCCCTGGAATACCAGGTACTAGAGGCCCTATTGGGCCACCAGGCATTCC
AGGATTCCCTGGGTCTAAAGGGGATCCAGGAAGTCCCGGTCCTCCTGGCCCAGCTGGCATAGCAACTAAGGGCCTCAATGGA
CCCACCGGGCCACCAGGGCCTCCAGGTCCAAGAGGCCCCTCTGGAGAGCCTGGTCTTCCAGGGCCCCCTGGGCCTCCAGGCC
CACCAGGTCAAGCAGTCATGCCTGAGGGTTTTATAAAGGCAGGCCAAAGGCCCAGTCTTTCTGGGACCCCTCTTGTTAGTGC
CAACCAGGGGTAACAGGAATGCCTGTGTCTGCTTTTACTGTTATTCTCTCCAAAGCTTACCCAGCAATAGGAACTCCCATA
CCATTTGATAAAATTTTGTATAACAGGCAACAGCATTATGACCCAAGGACTGGAATCTTTACTTGTCAGATACCAGGAATAT
ACTATTTTTCATACCACGTGCATGTGAAAGGGACTCATGTTTGGGTAGGCCTGTATAAGAATGGCACCCCTGTAATGTACAC
CTATGATGAATACACCAAAGGCTACCTGGATCAGGCTTCAGGGAGTGCCATCATCGATCTCACAGAAAATGACCAGGTGTGG
CTCCAGCTTCCCAATGCCGAGTCAAATGGCCTATACTCCTCTGAGTATGTCCACTCCTCTTTCTCAGGATTCCTAGTGGCTC
CAATGTGAGTACACCCCACAGAGCTAATCTAAATCTTGTGCTAGAAAAAGCATTCTCTAACTCTACCCCACCCTACAAAATG
CATATGGAGGTAGGCTGAAAAGAATGTAATTTTTATTTTCTGAAATACAGATTTGAGCTATCAGACCAACAAACCTTCCCCC
TGAAAAGTGAGCAGCAACGTAAAAACGTATGTGAAGCCTCTCTTGAATTTCTAGTTAGCAATCTTAAGGCTCTTTAAGGTTT
TCTCCAATATTAAAAAATATCACCAAAGAAGTCCTGCTATGTTAAAAACAAACAACAAAAAACAAAGCAACAAAAAAAAAAA
TTAAAAAAAAAAACAGAAATAGAGCTCTAAGTTATGTGAAATTTGATTTGAGAAACTCGGCATTTCCTTTTTAAAAAAGCCT
GTTTCTAACTATGAATATGAGAACTTCTAGGAAACATCCAGGAGGTATCATATAACTTTGTAGAACTTAAATACTTGAATAT
TCAAATTTAAAAGACACTGTATCCCCTAAAATATTTCTGATGGTGCACTACTCTGAGGCCTGTATGGCCCCTTTCATCAATA
TCTATTCAAATATACAGGTGCATATATACTTGTTAAAGCTCTTATATAAAAAAGCCCCAAAATATTGAAGTTCATCTGAAAT
GCAAGGTGCTTTCATCAATGAACCTTTTCAAAACTTTTCTATGATTGCAGAGAAGCTTTTTATATACCCAGCATAACTTGGA
AACAGGTATCTGACCTATTCTTATTTAGTTAACACAAGTGTGATTAATTTGATTTCTTTAATTCCTTATTGAATCTTATGTG
ATATGATTTTCTGGATTTACAGAACATTAGCACATGTACCTTGTGCCTCCCATTCAAGTGAAGTTATAATTTACACTGAGGG
TTTCAAAATTCGACTAGAAGTGGAGATATATTATTTATTTATGCACTGTACTGTATTTTTATATTGCTGTTTAAAACTTTTA
AGCTGTGCCTCACTTATTAAAGCACAAAATGTTTTACCTACTCCTTATTTACGACACAATAAAATAACATCAATAGATTTTT
AGGCTGAATTAATTTGAAAGCAGCAATTTGCTGTTCTCAACCATTCTTTCAAGGCTTTTCATTCGACACAATAAAATAACAT
CAATAGATTTTTAGGGATGGGTGGCTTT
```

FIGURE 6

```
CATGCCGCTGCCGCCGCTGCTGCTGTTGCTCCTGGCGGCGCCTTGGGGACGGGCAGTTCCCTGTGTCTCTGGTG
GTTTGCCTAAACCTGCAAACATCACCTTCTTATCCATCAACATGAAGAATGTCCTACAATGGACTCCACCAGAG
GGTCTTCAAGGAGTTAAAGTTACTTACACTGTGCAGTATTTCATATATGGGCAAAAGAAATGGCTGAATAAATC
AGAATGCAGAAATATCAATAGAACCTACTGTGATCTTTCTGCTGAAACTTCTGACTACGAACACCAGTATTATG
CCAAAGTTAAGGCCATTTGGGGAACAAAGTGTTCCAAATGGGCTGAAAGTGGACGGTTCTATCCTTTTTTAGAA
ACACAAATTGGCCCACCAGAGGTGGCACTGACTACAGATGAGAAGTCCATTTCTGTTGTCCTGACAGCTCCAGA
GAAGTGGAAGAGAAATCCAGAAGACCTTCCTGTTTCCATGCAACAAATATACTCCAATCTGAAGTATAACGTGT
CTGTGTTGAATACTAAATCAAACAGAACGTGGTCCCAGTGTGTGACCAACCACACGCTGGTGCTCACCTGGCTG
GAGCCGAACACTCTTTACTGCGTACACGTGGAGTCCTTCGTCCCAGGGCCCCCTCGCCGTGCTCAGCCTTCTGA
GAAGCAGTGTGCCAGGACTTTGAAAGATCAATCATCAGAGTTCAAGGCTAAAATCATCTTCTGGTATGTTTTGC
CCATATCTATTACCGTGTTTCTTTTTTCTGTGATGGGCTATTCCATCTACCGATATATCCACGTTGGCAAAGAG
AAACACCCAGCAAATTTGATTTTGATTTATGGAAATGAATTTGACAAAAGATTCTTTGTGCCTGCTGAAAAAAT
CGTGATTAACTTTATCACCCTCAATATCTCGGATGATTCTAAAATTTCTCATCAGGATATGAGTTTACTGGGAA
AAAGCAGTGATGTATCCAGCCTTAATGATCCTCAGCCCAGCGGGAACCTGAGGCCCCCTCAGGAGGAAGAGGAG
GTGAAACATTTAGGGTATGCTTCGCATTTGATGGAAATTTTTTGTGACTCTGAAGAAAACACGGAAGGTACTTC
TCTCACCCAGCAAGAGTCCCTCAGCAGAACAATACCCCCGGATAAAACAGTCATTGAATATGAATATGATGTCA
GAACCACTGACATTTGTGCGGGGCCTGAAGAGCAGGAGCTCAGTTTGCAGGAGGAGGTGTCCACACAAGGAACA
TTATTGGAGTCGCAGGCAGCGTTGGCAGTCTTGGGCCCGCAAACGTTACAGTACTCATACACCCCTCAGCTCCA
AGACTTAGACCCCCTGGCGCAGGAGCACACAGACTCGGAGGAGGGGCCGGAGGAAGAGCCATCGACGACCCTGG
TCGACTGGGATCCCCAAACTGGCAGGCTGTGTATTCCTTCGCTGTCCAGCTTCGACCAGGATTCAGAGGGCTGC
GAGCCTTCTGAGGGGGATGGGCTCGGAGAGGAGGGTCTTCTATCTAGACTCTATGAGGAGCCGGCTCCAGACAG
GCCACCAGGAGAAAATGAAACCTATCTCATGCAATTCATGGAGGAATGGGGGTTATATGTGCAGATGGAAAACT
GATGCCAACACTTCCTTTTGCCTTTTGTTTCCTGTGCAAACAAGTGAGTCACCCCTTTGATCCCAGCCATAAAG
TACCTGGGATGAAAGAAGTTTTTTCCAGTTTGTCAGTGTCTGTGAGAA
```

FIGURE 7

```
AGCGGGCGTGGGACTGAGCAGTCTGCTGCCCCCCGACATGTGACCCAGCCCCGCCGCCCATGCGGGCTCCCGGC
CGCCCGGCCCTGCGGCCGCTGCCGCTGCCGCCGCTGCTGCTGTTGCTCCTGGCGGCGCCTTGGGGACGGGCAGT
TCCCTGTGTCTCTGGTGGTTTGCCTAAACCTGCAAACATCACCTTCTTATCCATCAACATGAAGAATGTCCTAC
AATGGACTCCACCAGAGGGTCTTCAAGGAGTTAAAGTTACTTACACTGTGCAGTATTTCATATATGGGCAAAAG
AAATGGCTGAATAAATCAGAATGCAGAAATATCAATAGAACCTACTGTGATCTTTCTGCTGAAACTTCTGACTA
CGAACACCAGTATTATGCCAAAGTTAAGGCCATTTGGGGAACAAAGTGTTCCAAATGGGCTGAAAGTGGACGGT
TCTATCCTTTTTTAGAAACACAAATTGGCCCACCAGAGGTGGCACTGACTACAGATGAGAAGTCCATTTCTGTT
GTCCTGACAGCTCCAGAGAAGTGGAAGAGAAATCCAGAAGACCTTCCTGTTTCCATGCAACAAATATACTCCAA
TCTGAAGTATAACGTGTCTGTGTTGAATACTAAATCAAACAGAACGTGGTCCCAGTGTGTGACCAACCACACGC
TGGTGCTCACCTGGCTGGAGCCGAACACTCTTTACTGCGTACACGTGGAGTCCTTCGTCCCAGGGCCCCCTCGC
CGTGCTCAGCCTTCTGAGAAGCAGTGTGCCAGGACTTTGAAAGATCAATCATCAGAGTTCAAGGCTAAAATCAT
CTTCTGGTATGTTTTGCCCATATCTATTACCGTGTTTCTTTTTTCTGTGATGGGCTATTCCATCTACCGATATA
TCCACGTTGGCAAAGAGAAACACCCAGCAAATTTGATTTTGATTTATGGAAATGAATTTGACAAAAGATTCTTT
GTGCCTGCTGAAAAAATCGTGATTAACTTTATCACCCTCAATATCTCGGATGATTCTAAAATTTCTCATCAGGA
TATGAGTTTACTGGGAAAAAGCAGTGATGTATCCAGCCTTAATGATCCTCAGCCCAGCGGGAACCTGAGGCCCC
CTCAGGAGGAAGAGGAGGTGAAACATTTAGGGTATGCTTCGCATTTGATGGAAATTTTTGTGACTCTGAAGAA
AACACGGAAGGTACTTCTCTCACCCAGCAAGAGTCCCTCAGCAGAACAATACCCCCGGATAAAACAGTCATTGA
ATATGAATATGATGTCAGAACCACTGACATTTGTGCGGGGCCTGAAGAGCAGGAGCTCAGTTTGCAGGAGGAGG
TGTCCACACAAGGAACATTATTGGAGTCGCAGGCAGCGTTGGCAGTCTTGGGCCCGCAAACGTTACAGTACTCA
TACACCCCTCAGCTCCAAGACTTAGACCCCCTGGCGCAGGAGCACACAGACTCGGAGGAGGGGCCGGAGGAAGA
GCCATCGACGACCCTGGTCGACTGGGATCCCCAAACTGGCAGGCTGTGTATTCCTTCGCTGTCCAGCTTCGACC
AGGATTCAGAGGGCTGCGAGCCTTCTGAGGGGGATGGGCTCGGAGAGGAGGGTCTTCTATCTAGACTCTATGAG
GAGCCGGCTCCAGACAGGCCACCAGGAGAAAATGAAACCTATCTCATGCAATTCATGGAGGAATGGGGGTTATA
TGTGCAGATGGAAAACTGATGCCAACACTTCCTTTTGCCTTTTGTTTCCTGTGCAAACAAGTGAGTCACCCCTT
TGATCCCAGCCATAAAGTACCTGGGATGAAAGAAGTTTTTTCCAGTTTGTCAGTGTCTGTGAGAA
```

FIGURE 8

GCTTGGTCTAGTGCCCATTTACTCTGGACTCCGGATGGCTGCCGCACGCCTCTGCCTCTCCCTGCTGCTCCTGT
CCACCTGCGTGGCTCTGTTACTACAGCCACTGCTGGGTGCCCAGGGAGCCCCACTGGAGCCAGTGTACCCAGGG
GACAATGCCACACCAGAGCAGATGGCCCAGTATGCAGCTGATCTCCGTAGATACATCAACATGCTGACCAGGCC
TAGGTATGGGAAAAGACACAAAGAGGACACGCTGGCCTTCTCGGAGTGGGGGTCCCCGCATGCTGCTGTCCCCA
GGGAGCTCAGCCCGCTGGACTTATAATGCCACCTTCTGTCTCCTACGACTCCATGAGCAGCGCCAGCCCAGCTC
TCCCCTCTGCACCCTTGGCTCTGGCCAAAGCTTGCTCCCTGCTCCCACACAGGCTCAATAAAGCAAGTCAAAGC
CAAAAAAAAAAAAAAAAAAAAAAAAAAAAAAAAAAAAAAAAAAAAAAAAAAAAAAAAAAAAAAAAAAAAAAAAA
AAAAAAAAAAAAAAAAA

FIGURE 9

GAAGGACAGCAGGGCCAACAGTCACAGCAGCCCTGACCAGAGCATTCCTGGAGCTCAAGCTCCTCTACAAAGAG
GTGGACAGAGAAGACAGCAGAGACCATGGGACCCCCCTCAGCCCTCCCTGCAGATTGCATGTCCCCTGGAAGG
AGGTCCTGCTCACAGCCTCACTTCTAACCTTCTGGAACCCACCCACCACTGCCAAGCTCACTATTGAATCCACG
CCGTTCAATGTCGCAGAGGGGAAGGAGGTTCTTCTACTCGCCCACAACCTGCCCCAGAATCGTATTGGTTACAG
CTGGTACAAAGGCGAAAGAGTGGATGGCAACAGTCTAATTGTAGGATATGTAATAGGAACTCAACAAGCTACCC
CAGGGCCCGCATACAGTGGTCGAGAGACAATATACCCCAATGCATCCCTGCTGATCCAGAACGTCACCCAGAAT
GACACAGGATTCTATACCCTACAAGTCATAAAGTCAGATCTTGTGAATGAAGAAGCAACCGGACAGTTCCATGT
ATACCCGGAGCTGCCCAAGCCCTCCATCTCCAGCAACAACTCCAACCCCGTGGAGGACAAGGATGCTGTGGCCT
TCACCTGTGAACCTGAGGTTCAGAACACAACCTACCTGTGGTGGGTAAATGGTCAGAGCCTCCCGGTCAGTCCC
AGGCTGCAGCTGTCCAATGGCAACATGACCCTCACTCTACTCAGCGTCAAAAGGAACGATGCAGGATCCTATGA
ATGTGAAATACAGAACCCAGCGAGTGCCAACCGCAGTGACCCAGTCACCCTGAATGTCCTCTATGGCCCAGATG
GCCCCACCATTTCCCCCTCAAAGGCCAATTACCGTCCAGGGGAAAATCTGAACCTCTCCTGCCACGCAGCCTCT
AACCCACCTGCACAGTACTCTTGGTTTATCAATGGGACGTTCCAGCAATCCACACAAGAGCTCTTTATCCCCAA
CATCACTGTGAATAATAGCGGATCCTATATGTGCCAAGCCCATAACTCAGCCACTGGCCTCAATAGGACCACAG
TCACGATGATCACAGTCTCTGGAAGTGCTCCTGTCCTCTCAGCTGTGGCCACCGTCGGCATCACGATTGGAGTG
CTGGCCAGGGTGGCTCTGATATAGCAGCCCTGGTGTATTTTCGATATTTCAGGAAGACTGGCAGATTGGACCAG
ACCCTGAATTCTTCTAGCTCCTCCAATCCCATTTTATCCCATGGAACCACTAAAAACAAGGTCTGCTCTGCTCC
TGAAGCCCTATATGCTGGAGATGGACAACTCAATGAAAATTTAAAGGGAAAACCCTCAGGCCTGAGGTGTGTGC
CACTCAGAGACTTCACCTAACTAGAGACAGGCAAACTGCAAACCATGGTGAGAAATTGACGACTTCACACTATG
GACAGCTTTTCCCAAGATGTCAAAACAAGACTCCTCATCATGATAAGGCTCTTACCCCCTTTTAATTTGTCCTT
GCTTATGCCTGCCTCTTTCGCTTGGCAGGATGATGCTGTCATTAGTATTTCACAAGAAGTAGCTTCAGAGGGTA
ACTTAACAGAGTATCAGATCTATCTTGTCAATCCCAACGTTTTACATAAAATAAGAGATCCTTTAGTGCACCCA
GTGACTGACATTAGCAGCATCTTTAACACAGCCGTGTGTTCAAATGTACAGTGGTCCTTTTCAGAGTTGGACTT
CTAGACTCACCTGTTCTCACTCCCTGTTTTAATTCAACCCAGCCATGCAATGCCAAATAATAGAATTGCTCCCT
ACCAGCTGAACAGGGAGGAGTCTGTGCAGTTTCTGACACTTGTTGTTGAACATGGCTAAATACAATGGGTATCG
CTGAGACTAAGTTGTAGAAATTAACAAATGTGCTGCTTGGTTAAAATGGCTACACTCATCTGACTCATTCTTTA
TTCTATTTTAGTTGGNTTGTATCTTGCCTAAGGTGCGTAGTCCAACTCTTGGTATTACCCTCCTAATAGTCATA
CTAGTAGTCATACTCCCTGGTGTAGTGTATTCTCTAAAAGCTTTAAATGTCTGCATGCAGCCAGCCATCAAATA
GTGAATGGTCTCTCTTTGGCTGGAATTACAAAACTCAGAGAAATGTGTCATCAGGAGAACATCATAACCCATGA
AGGATAAAAGCCCCAAATGGTGGTAACTGATAATAGCACTAATGCTTTAAGATTTGGTCACACTCTCACCTAGG
TGAGCGCATTGAGCCAGTGGTGCATAAATGCTACATACTCCAACTGAAATGTTAAGGAAGAAGATAGATCCAAT
TAAAAAAAATTAAAACCAATTTAAAAAAAAAAAGAACACAGGAGATTCCAGTCTACTTGAGTTAGCATAATACA
GAAGTCCCCTCTACTTTAACTTTTACAAAAAAGTAACCTGAACTAATCTGATGTTAACCAATGTATTTATTTCT
GTGGTTCTGTTTCCTTGTTCCAATTTGACAAAACCCACTGTTCTTGTATTGTATTGCCCAGGGGAGCTATCAC
TGTACTTGTAGAGTGGTGCTGCTTTAATTCATAAATCACAAATAAAGCCAATTAGCTCTAAAAAAAAAAAA

FIGURE 10

```
GACCTGGGGGGGCGAGGGCCCCCCAAACTCAGTTCGGATCCTACCCGAGTGAGGCGGCGCCATGGAGCTCCGGG
TGCTGCTCTGCTGGGCTTCGTTGGCCGCAGCTTTGGAAGAGACCCTGCTGAACACAAAATTGGAAACTGCTGAT
CTGAAGTGGGTGACATTCCCTCAGGTGGACGGGCAGTGGGAGGAACTGAGCGGCCTGGATGAGGAACAGCACAG
CGTGCGCACCTACGAAGTGTGTGACGTGCAGCGTGCCCCGGGCCAGGCCCACTGGCTTCGCACAGGTTGGGTCC
CACGGCGGGGCGCCGTCCACGTGTACGCCACGCTGCGCTTCACCATGCTCGAGTGCCTGTCCCTGCCTCGGGCT
GGGCGCTCCTGCAAGGAGACCTTCACCGTCTTCTACTATGAGAGCGATGCGGACACGGCCACGGCCCTCACGCC
AGCCTGGATGGAGAACCCCTACATCAAGGTGGACACGGTGGCCGCGGAGCATCTCACCCGGAAGCGCCCTGGGG
CCGAGGCCACCGGGAAGGTGAATGTCAAGACGCTGCGTCTGGGACCGCTCAGCAAGGCTGGCTTCTACCTGGCC
TTCCAGGACCAGGGTGCCTGCATGGCCCTGCTATCCCTGCACCTCTTCTACAAAAAGTGCGCCCAGCTGACTGT
GAACCTGACTCGATTCCCGGAGACTGTGCCTCGGGAGCTGGTTGTGCCCGTGGCCGGTAGCTGCGTGGTGGATG
CCGTCCCCGCCCCTGGCCCCAGCCCCAGCCTCTACTGCCGTGAGGATGGCCAGTGGGCCGAACAGCCGGTCACG
GGCTGCAGCTGTGCTCCGGGGTTCGAGGCAGCTGAGGGGAACACCAAGTGCCGAGCCTGTGCCCAGGGCACCTT
CAAGCCCTGTCAGGAGAAGGGTCCTGCCAGCCATGCCCAGCCAATAGCCACTCTAACACCATTGGATCAGCCG
TCTGCCAGTGCCGCGTCGGGTACTTCCGGGCACGCACAGACCCCGGGGTGCACCCTGCACCACCCCTCCTTCG
GCTCCGCGGAGCGTGGTTTCCCGCCTGAACGGCTCCTCCCTGCACCTGGAATGGAGTGCCCCCCTGGAGTCTGG
TGGCCGAGAGGACCTCACCTACGCCCTCCGCTGCCGGGAGTGCCGACCCGGAGGCTCCTGTGCGCCCTGCGGGG
GAGACCTGACTTTTGACCCCGGCCCCCGGGACCTGGTGGAGCCCTGGGTGGTGGTTCGAGGGCTACGTCCTGAC
TTCACCTATACCTTTGAGGTCACTGCATTGAACGGGGTATCCTCCTTAGCCACGGGGCCCGTCCCATTTGAGCC
TGTCAATGTCACCACTGACCGAGAGGTACCTCCTGCAGTGTCTGACATCCGGGTGACGCGGTCCTCACCCAGCA
GCTTGAGCCTGGCCTGGGCTGTTCCCCGGGCACCCAGTGGGGCTGTGCTGGACTACGAGGTCAAATACCATGAG
AAGGGGCGCCGAGGGTCCCAGCAGCGTGCGGTTCCTGAAGACGTCAGAAAACCGGGCAGAGCTGCGGGGCTGAA
GCGGGGAGCCAGCTACCTGGTGCAGGTACGGGCGCGCTCTGAGGCCGGCTACGGGCCCTTCGGCCAGGAACATC
ACAGCCAGACCCAACTGGATGAGAGCGAGGGCTGGCGGGAGCAGCTGGCCCTGATTGCGGGCACGGCAGTCGTG
GGTGTGGTCCTGGTCCTGGTGGTCATTGTGGTCGCAGTTCTCTGCCTCAGGAAGCAGAGCAATGGGAGAGAAGC
AGAATATTCGGACAAACACGGACAGTATCTCATCGGACATGGTACTAAGGTCTACATCGACCCCTTCACTTATG
AAGACCCTAATGAGGCTGTGAGGGAATTTGCAAAAGAGATCGATGTCTCCTACGTCAAGATTGAAGAGGTGATT
GGTGCAGGTGAGTTTGGCGAGGTGTGTCGGGGGCGGCTCAAGGCCCCAGGGAAGAAGGAGAGCTGTGTGGCAAT
CAAGACCCTGAAGGGTGGCTACACGGAGCGGCAGCGGCGTGAGTTTCTGAGCGAGGCCTCCATCATGGGCCAGT
TCGAGCACCCCAATATCATCCGCCTGGAGGGCGTGGTCACCAACAGCATGCCCGTCATGATTCTCACAGAGTTC
ATGGAGAACGGCGCCCTGGACTCCTTCCTGCGGCTAAACGACGGACAGTTCACAGTCATCCAGCTCGTGGGCAT
GCTGCGGGGCATCGCCTCGGGCATGCGGTACCTTGCCGAGATGAGCTACGTCCACCGAGACCTGGCTGCTCGCA
ACATCCTAGTCAACAGCAACCTCGTCTGCAAAGTGTCTGACTTTGGCCTTTCCCGATTCCTGGAGGAGAACTCT
TCCGATCCCACCTACACGAGCTCCCTGGGAGGAAAGATTCCCATCCGATGGACTGCCCCGGAGGCCATTGCCTT
CCGGAAGTTCACTTCCGCCAGTGATGCCTGGAGTTACGGGATTGTGATGTGGGAGGTGATGTCATTTGGGGAGA
GGCCGTACTGGGACATGAGCAATCAGGACGTGATCAATGCCATTGAACAGGACTACCGGCTGCCCCCGCCCCCA
GACTGTCCCACCTCCCTCCACCAGCTCATGCTGGACTGTTGGCAGAAAGACCGGAATGCCCGGCCCCGCTTCCC
CCAGGTGGTCAGCGCCCTGGACAAGATGATCCGGAACCCCGCCAGCCTCAAAATCGTGGCCCGGGAGAATGGCG
GGGCCTCACACCCTCTCCTGGACCAGCGGCAGCCTCACTACTCAGCTTTTGGCTCTGTGGGCGAGTGGCTTCGG
GCCATCAAAATGGGAAGATACGAAGAAAGTTTCGCAGCCGCTGGCTTTGCTCCTTCGAGCTGGTCAGCCAGAT
CTCTGCTGAGGACCTGCTCCGAATCGGAGTCACTCTGGCGGGACACCAGAAGAAAATCTTGGCCAGTGTCCAGC
ACATGAAGTCCCAGGCCAAGCCGGGAACCCCGGGTGGGACAGGAGGACCGGCCCCGCAGTACTGACCTGCAGGA
ACTCCCCACCCCAGGGACACCGCCTCCCCATTTTCCGGGGCAGAGTGGGGACTCACAGAGGCCCCCAGCCCTGT
GCCCCGCTGGATTGCACTTTGAGCCCGTGGGTGAGGAGTTGGCAATTTGGAGAGACAGGATTTGGGGGTTCTG
CCATAATAGGAGGGGAAAATCACCCCCCAGCCACCTCGGGGAACTCCAGACCAAGGGTGAGGGCGCCTTTCCCT
CAGGACTGGGTGTGACCAGAGGAAAAGGAAGTGCCCAACATCTCCCAGCCTCCCCAGGTGCCCCCTCACCTTG
ATGGGTGCGTTCCCGCAGACCAAAGAGAGTGTGACTCCCTTGCCAGCTCCAGAGTGGGGGGCTGTCCCAGGGG
GCAAGAAGGGGTGTCAGGGCCCAGTGACAAAATCATTGGGGTTTGTAGTCCCAACTTGCTGCTGTCACCACCAA
ACTCAATCATTTTTTTCCCTTGTAAATGCCCCTCCCCAGCTGCTGCCTTCATATTGAAGGTTTTTGAGTTTTG
TTTTTGGTCTTAATTTTTCTCCCCGTTCCCTTTTTGTTTCTTCGTTTTGTTTTTCTACCGTCCTTGTCATAACT
TTGTGTTGGAGGGAACCTGTTTCACTATGGCCTCCTTTGCCCAAGTTGAAACAGGGGCCCATCATCATGTCTGT
TTCCAGAACAGTGCCTTGGTCATCCCACATCCCCGGACCCCGCCTGGGACCCCCAAGCTGTGTCCTATGAAGGG
GTGTGGGGTGAGGTAGTGAAAAGGGCGGTAGTTGGTGGTGGAACCCAGAAACGGACGCCGGTGCTTGGAGGGGT
TCTTAAATTATATTTAAAAAAGTAACTTTTTGTATAAATAAAGAAAATGGGACGTGTCCCAAAAAAAAAAAAA
AAAAAAAAAAAAAAAAAAAAAAAAAAAAAAAAAAAAAAAAGA
```

FIGURE 11

```
GCTCTATGCCGCCTACCTTGCTCTCGCCGCTGCTGCCGGAGCCGAAGCAGAGAAGGCAGCGGGTCCCGTGACCG
TCCCGAGAGCCCCGCGCTCCCGACCAGGGGGCGGGGCGGCCCCGGGGAGGGCGGGGCAGGGCGGGGGGAAGA
AAGGGGGTTTTGTGCTGCGCCGGGAGGGCCGGCGCCCTCTTCCGAATGTCCTGCGGCCCCAGCCTCTCCTCACG
CTCGCGCAGTCTCCGCCGCAGTCTCAGCTGCAGCTGCAGGACTGAGCCGTGCACCCGGAGGAGACCCCCGGAGG
AGGCGACAAACTTCGCAGTGCCGCGACCCAACCCCAGCCCTGGGTAGCCTGCAGCATGGCCCAGCTGTTCCTGC
CCCTGCTGGCAGCCCTGGTCCTGGCCCAGGCTCCTGCAGCTTTAGCAGATGTTCTGGAAGGAGACAGCTCAGAG
GACCGCGCTTTTCGCGTGCGCATCGCGGGCGACGCGCCACTGCAGGGCGTGCTCGGCGGCGCCCTCACCATCCC
TTGCCACGTCCACTACCTGCGGCCACCGCCGAGCCGCCGGGCTGTGCTGGGCTCTCCGCGGGTCAAGTGGACTT
TCCTGTCCCGGGGCCGGGAGGCAGAGGTGCTGGTGGCGCGGGGAGTGCGCGTCAAGGTGAACGAGGCCTACCGG
TTCCGCGTGGCACTGCCTGCGTACCCAGCGTCGCTCACCGACGTCTCCCTGGCGCTGAGCGAGCTGCGCCCAA
CGACTCAGGTATCTATCGCTGTGAGGTCCAGCACGGCATCGATGACAGCAGCGACGCTGTGGAGGTCAAGGTCA
AAGGGGTCGTCTTTCTCTACCGAGAGGGCTCTGCCCGCTATGCTTTCTCCTTTTCTGGGGCCCAGGAGGCCTGT
GCCCGCATTGGAGCCCACATCGCCACCCCGGAGCAGCTCTATGCCGCCTACCTTGGGGGCTATGAGCAATGTGA
TGCTGGCTGGCTGTCGGATCAGACCGTGAGGTATCCCATCCAGACCCCACGAGAGGCCTGTTACGGAGACATGG
ATGGCTTCCCCGGGGTCCGGAACTATGGTGTGGTGGACCCGGATGACCTCTATGATGTGTACTGTTATGCTGAA
GACCTAAATGGAGAACTGTTCCTGGGTGACCCTCCAGAGAAGCTGACATTGGAGGAAGCACGGGCGTACTGCCA
GGAGCGGGGTGCAGAGATTGCCACCACGGGCCAACTGTATGCAGCCTGGGATGGTGGCCTGGACCACTGCAGCC
CAGGGTGGCTAGCTGATGGCAGTGTGCGCTACCCCATCGTCACACCCAGCCAGCGCTGTGGTGGGGCTTGCCT
GGTGTCAAGACTCTCTTCCTCTTCCCCAACCAGACTGGCTTCCCCAATAAGCACAGCCGCTTCAACGTCTACTG
CTTCCGAGACTCGGCCCAGCCTTCTGCCATCCCTGAGGCCTCCAACCCAGCCTCCAACCCAGCCTCTGATGCAC
TAGAGGCTATCGTCACAGTGACAGAGACCCTGGAGGAACTGCAGCTGCCTCAGGAAGCCACAGAGAGTGAATCC
CGTGGGGCCATCTACTCCATCCCCATCATGGAGGACGGAGGAGGTGGAAGCTCCACTCCAGAAGACCCAGCAGA
GGCCCCTAGGACGCTCCTAGAATTTGAAACACAATCCATGGTACCGCCCACGGGGTTCTCAGAAGAGGAAGGTA
AGGCATTGGAGGAAGAAGAGAAATATGAAGATGAAGAAGAGAAAGAGGAGGAAGAAGAAGAGGAGGAGGTGGAG
GATGAGGCTCTGTGGGCATGGCCCAGCGAGCTCAGCAGCCCGGGCCCTGAGGCCTCTCTCCCCACTGAGCCAGC
AGCCCAGGAGAAGTCACTCTCCCAGGCGCCAGCAAGGGCAGTCCTGCAGCCTGGTGCATCACCACTTCCTGATG
GAGAGTCAGAAGCTTCCAGGCCTCCAAGGGTCCATGGACCACCTACTGAGACTCTGCCCACTCCCAGGGAGAGG
AACCTAGCATCCCCATCACCTTCCACTCTGGTTGAGGCAAGAGAGGTGGGGGAGGCAACTGGTGGTCCTGAGCT
ATCTGGGGTCCCTCGAGGAGAGAGCGAGGAGACAGGAAGCTCCGAGGGTGCCCCTTCCCTGCTTCCAGCCACAC
GGGCCCCTGAGGGTACCAGGGAGCTGGAGGCCCCCTCGAAGATAATTCTGGAAGAACTGCCCCAGCAGGGACC
TCAGTGCAGGCCCAGCCAGTGCTGCCCACTGACAGCGCCAGCCGAGCTGGAGTGGCCGTGGTCCCCGCATCAGG
TGACTGTGTCCCCAGCCCCTGCCACAATGGTGGGACATGCTTGGAGGAGGAGGAAGGGGTCCGCTGCCTATGTC
TGCCTGGCTATGGGGGGACCTGTGCGATGTTGGCCTCCGCTTCTGCAACCCCGGCTGGGACGCCTTCCAGGGC
GCCTGCTACAAGCACTTTTCCACACGAAGGAGCTGGGAGGAGGCAGAGACCCAGTGCCGGATGTACGGCGCGCA
TCTGGCCAGCATCAGCACACCCGAGGAACAGGACTTCATCAACAACCGGTACCGGGAGTACCAGTGGATCGGAC
TCAACGACAGGACCATCGAAGGCGACTTCTTGTGGTCGGATGGCGTCCCCCTGCTCTATGAGAACTGGAACCCT
GGGCAGCCTGACAGCTACTTCCTGTCTGGAGAGAACTGCGTGGTCATGGTGTGGCATGATCAGGGACAATGGAG
TGACGTGCCCTGCAACTACCACCTGTCCTACACCTGCAAGATGGGCTGGTGTCCTGTGGGCCGCCACCGGAGC
TGCCCCTGGCTCAAGTGTTCGGCCGCCCACGGCTGCGCTATGAGGTGGACACTGTGCTTCGCTACCGGTGCCGG
GAAGGACTGGCCCAGCGCAATCTGCCGCTGATCCGATGCCAAGAGAACGGTCGTTGGGAGGCCCCCAGATCTC
CTGTGTGCCCAGAAGACCTGCCCGAGCTCTGCACCCAGAGGAGGACCCAGAAGGACGTCAGGGGAGGCTACTGG
GACGCTGGAAGGCGCTGTTGATCCCCCCTTCCAGCCCATGCCAGGTCCCTAGGGGCAAGGCCTTGAACACTG
CCGGCCACAGCACTGCCCTGTCACCCAAATTTTCCCTCACACCTTGCGCTCCCGCCACCACAGGAAGTGACAAC
ATGACGAGGGGTGGTGCTGGAGTCCAGGTGACAGTTCCTGAAGGGGCTTCTGGGAAATACCTAGGAGGCTCCAG
CCCAGCCCAGGCCCTCTCCCCCTACCCTGGGCACCAGATCTTCCATCAGGGCCGGAGTAAATCCCTAAGTGCCT
CAACTGCCCTCTCCCTGGCAGCCATCTTGTCCCCTCTATTCCTCTAGGGAGCACTGTGCCCACTCTTTCTGGGT
TTTCCAAGGGAATGGGCTTGCAGGATGGAGTGTCTGTAAAATCAACAGGAAATAAAACTGTGTATGAGCCCA
```

FIGURE 12

```
TGTGGCACTGCCTGCGTACCCAACCCCAGCCCTGGGTAGCCTGCAGCATGGCCCAGCTGTTCCTGCCCCTGCTG
GCAGCCCTGGTCCTGGCCCAGGCTCCTGCAGCTTTAGCAGATGTTCTGGAAGGAGACAGCTCAGAGGACCGCGC
TTTTCGCGTGCGCATCGCGGGCGACGCGCCACTGCAGGGCGTGCTCGGCGGCGCCCTCACCATCCCTTGCCACG
TCCACTACCTGCGGCCACCGCCGAGCCGCCGGGCTGTGCTGGGCTCTCCGCGGGTCAAGTGGACTTTCCTGTCC
CGGGGCCGGGAGGCAGAGGTGCTGGTGGCGCGGGGAGTGCGCGTCAAGGTGAACGAGGCCTACCGGTTCCGCGT
GGCACTGCCTGCGTACCCAGCGTCGCTCACCGACGTCTCCCTGGCGCTGAGCGAGCTGCGCCCCAACGACTCAG
GTATCTATCGCTGTGAGGTCCAGCACGGCATCGATGACAGCAGCGACGCTGTGGAGGTCAAGGTCAAAGGGGTC
GTCTTTCTCTACCGAGAGGGCTCTGCCCGCTATGCTTTCTCCTTTTCTGGGGCCCAGGAGGCCTGTGCCCGCAT
TGGAGCCCACATCGCCACCCCGGAGCAGCTCTATGCCGCCTACCTTGGGGGCTATGAGCAATGTGATGCTGGCT
GGCTGTCGGATCAGACCGTGAGGTATCCCATCCAGACCCCACGAGAGGCCTGTTACGGAGACATGGATGGCTTC
CCCGGGGTCCGGAACTATGGTGTGGTGGACCCGGATGACCTCTATGATGTGTACTGTTATGCTGAAGACCTAAA
TGGAGAATTGTTCCTGGGTGACCCTCCAGAGAAGCTGACATTGGAGGAAGCACGGGCGTACTGCCAGGAGCGGG
GTGCAGAGATTGCCACCACGGGCCAACTGTATGCAGCCTGGGATGGTGGCCTGGACCACTGCAGCCCAGGGTGG
CTAGCTGATGGCAGTGTGCGCTACCCCATCGTCACACCCAGCCAGCGCTGTGGTGGGGCTTGCCTGGTGTCAA
GACTCTCTTCCTCTTCCCCAACCAGACTGGCTTCCCCAATAAGCACAGCCGCTTCAACGTCTACTGCTTCCGAG
ACTCGGCCCAGCCTTCTGCCATCCCTGAGGCCTCCAACCCAGCCTCCAACCCAGCCTCTGATGGACTAGAGGCT
ATCGTCACAGTGACAGAGACCCTGGAGGAACTGCAGCTGCCTCAGGAAGCCACAGAGAGTGAATCCCGTGGGGC
CATCTACTCCATCCCCATCATGGAGGACGGAGGAGGTGGAAGCTCCACTCCAGAAGACCCAGCAGAGGCCCCTA
GGACGCTCCTAGAATTTGAAACACAATCCATGGTACCGCCCACGGGGTTCTCAGAAGAGGAAGGTAAGGCATTG
GAGGAAGAAGAGAAATATGAAGATGAAGAAGAGAAAGAGGAGGAAGAAGAAGAGGAGGAGGTGGAGGATGAGGC
TCTGTGGGCATGGCCCAGCGAGCTCAGCAGCCCGGGCCCTGAGGCCTCTCTCCCACTGAGCCAGCAGCCCAGG
AGGAGTCACTCTCCCAGGCGCCAGCAAGGGCAGTCCTGCAGCCTGGTGCATCACCACTTCCTGATGGAGAGTCA
GAAGCTTCCAGGCCTCCAAGGGTCCATGGACCACCTACTGAGACTCTGCCCACTCCCAGGGAGAGGAACCTAGC
ATCCCCATCACCTTCCACTCTGGTTGAGGCAAGAGAGGTGGGGGAGGCAACTGGTGGTCCTGAGCTATCTGGGG
TCCCTCGAGGAGAGAGCGAGGAGACAGGAAGCTCCGAGGGTGCCCCTTCCCTGCTTCCAGCCACACGGGCCCCT
GAGGGTACCAGGGAGCTGGAGGCCCCCTCTGAAGATAATTCTGGAAGAACTGCCCCAGCAGGGACCTCAGTGCA
GGCCCAGCCAGTGCTGCCCACTGACAGCGCCAGCCGAGGTGGAGTGGCCGTGGTCCCGCATCAGGTAATTCTG
CCCAAGGCTCAACTGCCCTCTCTATCCTACTCCTTTTCTTCCCCCTGCAGCTCTGGGTCACCTGACCTGTAGTC
CTTTAACCCACCATCATCCCAAACTCTCCTGTCCTTTGCCTTCATTCTCTTACCCACCTCTACCTATGGGTCTC
CAATCTCGGATATCCACCTTGTGGGTATCTCAGCTCTCCGCGTCTTTACCCTGTGATCCCAGCCCCGCCACTGA
CCATCTGTGACCCTTCCCTGCCATTGGGCCCTCCACCTGTGGCTCACATCTCGCCAGCCCCACAGAGCATCCTC
AGGCCTCTCCAAGGGTCCTCATCACCTATTGCAGCCTTCAGGGCTCGGCCTATTTTCCACTACTCCCTTCATCC
GCCTGTGTGCCGTCCCCTTTAGCTGCCTCCTATTGATCTCAGGGAAGCCTGGGAGTCCCTTCTCACCCCTCAAC
CTCCGGAGTCCAGGAGAACCCGTACCCCACAGAGCCTTAAGCAACTACTTCTGTGAAGTATTTTTTGACTGTT
TCATGGAAAACAAGCCTTGGAAATAAATCTCTATTAAACCGC
```

FIGURE 13

AGCCAGCTCAGGCTACACTATCCCAGGATCAGCATGGCCGTCCGCCAGTGGGTAATCGCCCTGGCCTTGGCTGC
CCTCCTTGTTGTGGACAGGGAAGTGCCAGTGGCAGCAGGAAAGCTCCCTTTCTCAAGAATGCCCATCTGTGAAC
ACATGGTAGAGTCTCCAACCTGTTCCCAGATGTCCAACCTGGTCTGCGGCACTGATGGGCTCACATATACGAAT
GAATGCCAGCTCTGCTTGGCCCGGATAAAAACCAAACAGGACATCCAGATCATGAAAGATGGCAAATGCTGATC
CCACAGGAGCACCTCAAGCCATGAAGTGTCAGCTGGAGAACAGTGGTGGGCATGGAGAGGATATGACATGAAAT
AAAAGATCCAGCCCAAAAAAAAAAGAAAAAA

FIGURE 14

CGTTTCCAATGCACGTACAGCCCGTACACACCGTGTGCTGGGACACCCCACAGTCAGCCGCATGGCTCCCCTGT
GCCCCAGCCCCTGGCTCCCTCTGTTGATCCCGGCCCTGCTCCAGGCCTCACTGTGCAACTGCTGCTGTCACTG
CTGCTTCTGGTGCCTGTCCATCCCCAGAGGTTGCCCCGGATGCAGGAGGATTCCCCCCTGGGAGGAGGCTCTTC
TGGGGAAGATGACCCACTGGGCGAGGAGGATCTGCCCAGTGAAGAGGATTCACCCAGAGAGGAGGATCCACCCG
GAGAGGAGGATCTACCTGGAGAGGAGGATCTACCTGGAGAGGAGGATCTACCTGAAGTTAAGCCTAAATCAGAA
GAAGAGGGCTCCCTGAAGTTAGAGGATCTACCTACTGTTGAGGCTCCTGGAGATCCTCAAGAACCCCAGAATAA
TGCCCACAGGGACAAAGAAGGGGATGACCAGAGTCATTGGCGCTATGGAGGCGACCCGCCCTGGCCCCGGGTGT
CCCCAGCCTGCGCGGGCCGCTTCCAGTCCCCGGTGGATATCCGCCCCAGCTCGCCGCCTTCTGCCCGGCCCTG
CGCCCCTGGAACTCCTGGGCTTCCAGCTCCCGCCGCTCCCAGAACTGCGCCTGCGCAACAATGGCCACAGTGT
GCAACTGACCCTGCCTCCTGGGCTAGAGATGGCTCTGGGTCCCGGGCGGGAGTACCGGGCTCTGCAGCTGCATC
TGCACTGGGGGGCTGCAGGTCGTCCGGGCTCGGAGCACACTGTGGAAGGCCACCGTTTCCCTGCCGAGATCCAC
GTGGTTCACCTCAGCACCGCCTTTGCCAGAGTTGACGAGGCCTTGGGGCGCCCGGGAGGCCTGGCCGTGTTGGC
CGCCTTTCTGGAGGAGGGCCCGGAAGAAAACAGTGCCTATGAGCAGTTGCTGTCTCGCTTGGAAGAAATCGCTG
AGGAAGGCTCAGAGACTCAGGTCCCAGGACTGGACATATCTGCACTCCTGCCCTCTGACTTCAGCCGCTACTTC
CGATATGAGGGGTCTCTGACTACACCGCCCTGTGCCCAGGGTGTCATCTGGACTGTGTTTAACCAGACAGTGAT
GCTGAGTGCTAAGCAGCTCCACACCCTCTCTGACACCCTGTGGGACCTGGTGACTCTCGGCTACAGCTGAACT
TCCGAGCGACGCAGCCTTTGAATGGGCGAGTGATTGAGGCCTCCTTCCCTGCTGGAGTGGACAGCAGTCCTCGG
GCTGCTGAGCCAGTCCAGCTGAATTCCTGCCTGGCTGCTGGTGACATCCTAGCCCTGGTTTTTGGCCTCCTTTT
TGCTGTCACCAGCGTCGCGTTCCTTGTGCAGATGAGAAGGCAGCACAGAAGGGGAACCAAAGGGGGTGTGAGCT
ACCGCCCAGCAGAGGTAGCCGAGACTGGAGCCTAGAGGCTGGATCTTGGAGAATGTGAGAAGCCAGCCAGAGGC
ATCTGAGGGGGAGCCGGTAACTGTCCTGTCCTGCTCATTATGCCACTTCCTTTTAACTGCCAAGAAATTTTTTA
AAATAAATATTTATAATA

FIGURE 15

TCCACATCCAGGTCTTTGTGCTCCTCGCTTGCCTGTTCCTTTTCCACGCATTTTCCAGGATAACTGTGACTCCA
GGCCCGCAATGGATGCCCTGCAACTAGCAAATTCGGCTTTTGCCGTTGATCTGTTCAAACAACTATGTGAAAAG
GAGCCACTGGGCAATGTCCTCTTCTCTCCAATCTGTCTCTCCACCTCTCTGTCACTTGCTCAAGTGGGTGCTAA
AGGTGACACTGCAAATGAAATTGGACAGGTTCTTCATTTTGAAAATGTCAAAGATGTACCCTTTGGATTTCAAA
CAGTAACATCGGATGTAAACAAACTTAGTTCCTTTTACTCACTGAAACTAATCAAGCGGCTCTACGTAGACAAA
TCTCTGAATCTTTCTACAGAGTTCATCAGCTCTACGAAGAGACCGTATGCAAAGGAATTGGAAACTGTTGACTT
CAAAGATAAATTGGAAGAAACGAAAGGTCAGATCAACAACTCAATTAAGGATCTCACAGATGGCCACTTTGAGA
ACATTTTAGCTGACAACAGTGTGAACGACCAGACCAAAATCCTTGTGGTTAATGCTGCCTACTTTGTTGGCAAG
TGGATGAAGAAATTTTCTGAATCAGAAACAAAAGAATGTCCTTTCAGAGTCAACAAGACAGACACCAAACCAGT
GCAGATGATGAACATGGAGGCCACGTTCTGTATGGGAAACATTGACAGTATCAATTGTAAGATCATAGAGCTTC
CTTTTCAAAATAAGCATCTCAGCATGTTCATCCTACTACCCAAGGATGTGGAGGATGAGTCCACAGGCTTGGAG
AAGATTGAAAAACAACTCAACTCAGAGTCACTGTCACAGTGGACTAATCCCAGCACCATGGCCAATGCCAAGGT
CAAACTCTCCATTCCAAAATTTAAGGTGGAAAAGATGATTGATCCCAAGGCTTGTCTGGAAAATCTAGGGCTGA
AACATATCTTCAGTGAAGACACATCTGATTTCTCTGGAATGTCAGAGACCAAGGGAGTGGCCCTATCAAATGTT
ATCCACAAAGTGTGCTTAGAAATAACTGAAGATGGTGGGGATTCCATAGAGGTGCCAGGAGCACGGATCCTGCA
GCACAAGGATGAATTGAATGCTGACCATCCCTTTATTTACATCATCAGGCACAACAAAACTCGAAACATCATTT
TCTTTGGCAAATTCTGTTCTCCTTAAGTGGCATAGCCCATGTTAAGTCCTCCCTGACTTTTCTGTGGATGCCGA
TTTCTGTAAACTCTGCATCCAGAGATTCATTTTCTAGATACAATAAATTGCTAATGTTGCTGGATCAGGAAGCC
GCCAGTACTTGTCATATGTAGCCTTCACACAGATAGACCTTTTTTTTTTTCCAATTCTATCTTTTGTTTCCTT
TTTTCCCATAAGACAATGACATACGCTTTTAATGAAAAGGAATCACGTTAGAGGAAAAATATTTATTCATTATT
TGTCAAATTGTCCGGGTTAGTTGGCAGAAATACAGTCTTCCACAAAGAAAATTCCTATAAGGAAGATTTGGAAG
CTCTTCTTCCCAGCACTATGCTTTCCTTCTTTGGGATAGAGAATGTTCCAGACATTCTCGCTTCCCTGAAAGAC
TGAAGAAAGTGTAGTGCATGGGACCCACGAAACTGCCCTGGCTCCAGTGAAACTTGGGCACATGCTCAGGCTAC
TATAGGTCCAGAAGTCCTTATGTTAAGCCCTGGCAGGCAGGTGTTTATTAAAATTCTGAATTTTGGGGATTTTC
AAAAGATAATATTTTACATACACTGTATGTTATAGAACTTCATGGATCAGATCTGGGGCAGCACCCTATAAATC
AACACCTTAATATGCTGCAACAAAATGTAGAATATTCAGACAAAATGGATACATAAAGACTAAGTAGCCCATAA
GGGGTCAAAATTTGCTGCCAAATGCGTATGCCACCAACTTACAAAAACACTTCGTTCGCAGAGCTTTTCAGATT
GTGGAATGTTGGATAAGGAATTATAGACCTCTAGTAGCTGAAATGCAAGACCCCAAGAGGAAGTTCAGATCTTA
ATATAAATTCACTTTCATTTTTGATAGCTGTCCCATCTGGTCATTTGGTTGGCACTAGACTGGTGGCAGGGCT
TCTAGCTGACTTGCACAGGGATTCTCACAATAGCCGATATCAGAATTTGTGTTGAAGGAACTTGTCTCTTCATC
TAATATGATAGCGGGAAAAGGAGAGGAAACTACTGCCTTTAGAAAATATAAGTAAAGTGATTAAAGTGCTCACG
TTACCTTGACACATAGTTTTTCAGTCTATGGGTTTAGTTACTTTAGATGGCAAGCATGTAACTTATATTAATAG
TAATTTGTAAAGTTGGTTGGATAAGCTATCCGTGTTGCAGGTTCATGGATTACTTCTCTATAAAAAATATGTAT
TTACCAAAAATTTTGTGACATTCCTTCTCCCATCTCTTCCTTGACCTGCATTGTAAATAGGTTCTTCTTGTTCT
GAGATTCAATATTGAATTTTTCCTATGCTATTGACAATAAAATATTATTGAACTACA

FIGURE 16

```
GCCGAGCCGGGGCTCCGGAAGCCGGCGGGGGCGCCGCGGCCGTGCGGGGCGTCAATGGATCGCCACTCCAGCTA
CATCTTCATCTGGCTGCAGCTGGAGCTCTGCGCCATGGCCGTGCTGCTCACCAAAGGTGAAATTCGATGCTACT
GTGATGCTGCCCACTGTGTAGCCACTGGTTATATGTGTAAATCTGAGCTCAGCGCCTGCTTCTCTAGACTTCTT
GATCCTCAGAACTCAAATTCCCCACTCACCCATGGCTGCCTGGACTCTCTTGCAAGCACGACAGACATCTGCCA
AGCCAAACAGGCCCGAAACCACTCTGGCACCACCATACCCACATTGGAATGCTGTCATGAAGACATGTGCAATT
ACAGAGGGCTGCACGATGTTCTCTCTCCTCCCAGGGGTGAGGCCTCAGGACAAGGAAACAGGTATCAGCATGAT
GGTAGCAGAAACCTTATCACCAAGGTGCAGGAGCTGACTTCTTCCAAAGAGTTGTGGTTCCGGGCAGCGGTCAT
TGCCGTGCCCATTGCTGGAGGGCTGATTTTAGTGTTGCTTATTATGTTGGCCCTGAGGATGCTTCGAAGTGAAA
ATAAGAGGCTGCAGGATCAGCGGCAACAGATGCTCTCCCGTTTGCACTACAGCTTTCACGGACACCATTCCAAA
AAGGGGCAGGTTGCAAAGTTAGACTTGGAATGCATGGTGCCGGTCAGTGGGCACGAGAACTGCTGTCTGACCTG
TGATAAAATGAGACAAGCAGACCTCAGCAACGATAAGATCCTCTCGCTTGTTCACTGGGGCATGTACAGTGGGC
ACGGGAAGCTGGAATTCGTATGACGGAGTCTTATCTGAACTACACTTACTGAACAGCTTGAAGGCCTTTTGAGT
TCTGCTGGACAGGAGCACTTTATCTGAAGACAAACTCATTTAATCATCTTTGACAGACAAAATGACCTCTGCAA
ACAGAATCTTGGATATTTCTTCTGAAGGATTATTTGCACAGACTTAAATACAGTTAAATGTGTTATTTGCTTTT
AAAATTATAAAAAGCAAAGAGAAGACTTTGTACACACTGTCACCAGGGTTATTTGCATCCAAGGGAGCTGGAAT
TGAGTACCTAAATAAACAAAAATGTGCCCTAAAAA
```

FIGURE 17A

```
GTCACTTAGGAAAAGGTGTCCTTTCGGGCAGCCGGGCTCAGCATGAGGAACAGAAGGAATGACACTCTGGACAG
CACCCGGACCCTGTACTCCAGCGCGTCTCGGAGCACAGACTTGTCTTACAGTGAAAGCGACTTGGTGAATTTTA
TTCAAGCAAATTTTAAGAAACGAGAATGTGTCTTCTTTACCAAAGATTCCAAGGCCACGGAGAATGTGTGCAAG
TGTGGCTATGCCCAGAGCCAGCACATGGAAGGCACCCAGATCAACCAAAGTGAGAAATGGAACTACAAGAAACA
CACCAAGGAATTTCCTACCGACGCCTTTGGGGATATTCAGTTTGAGACACTGGGGAAGAAAGGGAAGTATATAC
GTCTGTCCTGCGACACGGACGCGGAAATCCTTTACGAGCTGCTGACCCAGCACTGGCACCTGAAAACACCCAAC
CTGGTCATTTCTGTGACCGGGGCGCCAAGAACTTCGCCCTGAAGCCGCGCATGCGCAAGATCTTCAGCCGGCT
CATCTACATCGCGCAGTCCAAAGGTGCTTGGATTCTCACGGGAGGCACCCATTATGGCCTGACGAAGTACATCG
GGGAGGTGGTGAGAGATAACACCATCAGCAGGAGTTCAGAGGAGAATATTGTGGCCATTGGCATAGCAGCTTGG
GGCATGGTCTCCAACCGGGACACCCTCATCAGGAATTGCGATGCTGAGGGCTATTTTTAGCCCAGTACCTTAT
GGATGACTTCACAAGGGATCCACTGTATATCCTGGACAACAACCACACACATTTGCTGCTCGTGGACAATGGCT
GTCATGGACATCCCACTGTCGAAGCAAAGCTCCGGAATCAGCTAGAGAAGCATATCTCTGAGCGCACTATTCAA
GATTCCAACTATGGTGGCAAGATCCCCATTGTGTGTTTTGCCCAAGGAGGTGGAAAAGAGACTTTGAAAGCCAT
CAATACCTCCATCAAAAATAAAATTCCTTGTGTGGTGGTGGAAGGCTCGGGCCGGATCGCTGATGTGATCGCTA
GCCTGGTGGAGGTGGAGGATGCCCCGACATCTTCTGCCGTCAAGGAGAAGCTGGTGCGCTTTTTACCCCGCACG
GTGTCCCGGCTGTCTGAGGAGGAGACTGAGAGTTGGATCAAATGGCTCAAAGAAATTCTCGAATGTTCTCACCT
ATTAACAGTTATTAAAATGGAAGAAGCTGGGGATGAAATTGTGAGCAATGCCATCTCCTACGCTCTATACAAAG
CCTTCAGCACCAGTGAGCAAGACAAGGATAACTGGAATGGGCAGCTGAAGCTTCTGCTGGAGTGGAACCAGCTG
GACTTAGCCAATGATGAGATTTTCACCAATGACCGCCGATGGGAGTCTGCTGACCTTCAAGAAGTCATGTTTAC
GGCTCTCATAAAGGACAGACCCAAGTTTGTCCGCCTCTTTCTGGAGAATGGCTTGAACCTACGGAAGTTTCTCA
CCCATGATGTCCTCACTGAACTCTTCTCCAACCACTTCAGCACGCTTGTGTACCGGAATCTGCAGATCGCCAAG
AATTCCTATAATGATGCCCTCCTCACGTTTGTCTGGAAACTGGTTGCGAACTTCCGAAGAGGCTTCCGGAAGGA
AGACAGAAATGGCCGGGACGAGATGGACATAGAACTCCACGACGTGTCTCCTATTACTCGGCACCCCCTGCAAG
CTCTCTTCATCTGGGCCATTCTTCAGAATAAGAAGGAACTCTCCAAAGTCATTTGGGAGCAGACCAGGGGCTGC
ACTCTGGCAGCCCTGGGAGCCAGCAAGCTTCTGAAGACTCTGGCCAAAGTGAAGAACGACATCAATGCTGCTGG
GGAGTCCGAGGAGCTGGCTAATGAGTACGAGACCCGGGCTGTTGAGCTGTTCACTGAGTGTTACAGCAGCGATG
AAGACTTGGCAGAACAGCTGCTGGTCTATTCCTGTGAAGCTTGGGGTGGAAGCAACTGTCTGGAGCTGGCGGTG
GAGGCCACAGACCAGCATTTCACCGCCCAGCCTGGGGTCCAGAATTTTCTTTCTAAGCAATGGTATGGAGAGAT
TCCCGAGACACCAAGAACTGGAAGATTATCCTGTGTCTGTTTATTATACCCTTGGTGGGCTGTGGCTTTGTAT
CATTTAGGAAGAAACCTGTCGACAAGCACAAGAAGCTGCTTTGGTACTATGTGGCGTTCTTCACCTCCCCCTTC
GTGGTCTTCTCCTGGAATGTGGTCTTCTACATCGCCTTCCTCCTGCTGTTTGCCTACGTGCTGCTCATGGATTT
CCATTCGGTGCCACACCCCCCCGAGCTGGTCCTGTACTCGCTGGTCTTTGTCCTCTTCTGTGATGAAGTGAGAC
AGTGGTACGTAAATGGGGTGAATTATTTTACTGACCTGTGGAATGTGATGGACACGCTGGGGCTTTTTACTTC
ATAGCAGGAATTGTATTTCGGCTCCACTCTTCTAATAAAAGCTCTTTGTATTCTGGACGAGTCATTTCTGTCT
GGACTACATTATTTTCACTCTAAGATTGATCCACATTTTTACTGTAAGCAGAAACTTAGGACCCAAGATTATAA
TGCTGCAGAGGATGCTGATCGATGTGTTCTTCTTCCTGTTCCTCTTTGCGGTGTGGATGGTGGCCTTTGGCGTG
GCCAGGCAAGGGATCCTTAGGCAGAATGAGCAGCGCTGGAGGTGGATATTCCGTTCGGTCATCTACGAGCCCTA
CCTGGCCATGTTCGGCCAGGTGCCCAGTGACGTGGATGGTACCACGTATGACTTTGCCCACTGCACCTTCACTG
GAATGAGTCCAAGCCACTGTGTGTGGAGCTGGATGAGCACAACCTGCCCCGGTTCCCCGAGTGGATCACCATC
CCCCTGGTGTGCATCTACATGTTATCCACCAACATCCTGCTGGTCAACCTGCTGGTCGCCATGTTTGGCTACAC
GGTGGGCACCGTCCAGGAGAACAATGACCAGGTCTGGAAGTTCCAGAGGTACTTCCTGGTGCAGGAGTACTGCA
```

FIGURE 17B

```
GCCGCCTCAATATCCCCTTCCCCTTCATCGTCTTCGCTTACTTCTACATGGTGGTGAAGAAGTGCTTCAAGTGT
TGCTGCAAGGAGAAAAACATGGAGTCTTCTGTCTGCTGTTTCAAAAATGAAGACAATGAGACTCTGGCATGGA
GGGTGTCATGAAGGAAAACTACCTTGTCAAGATCAACACAAAAGCCAACGACACCTCAGAGGAAATGAGGCATC
GATTTAGACAACTGGATACAAAGCTTAATGATCTCAAGGGTCTTCTGAAAGAGATTGCTAATAAAATCAAATAA
AACTGTATGAAACTCTAATGGAGAAAAATCTAATTATAGCAAGATCATATTAAGGAATGCTGATGAACAATTTT
GCTATCGACTACTAAATGAGAGATTTTCAGACCCCTGGGTACATGGTGGATGATTTTAAATCACCCTAGTGTGC
TGAGACCTTGAGAATAAAGTGTGTGATTGGTTTCATACTTGAAGACGGATATAAAGGAAGAATATTTCCTTTAT
GTGTTTCTCCAGAATGGTGCCTGTTTCTCTCTGTGTCTCAATGCCTGGGACTGGAGGTTGATAGTTTAAGTGTG
TTCTTACCGCCTCCTTTTTCCTTTAATCTTATTTTTGATGAACACATATATAGGAGAACATCTATCCTATGAAT
AAGAACCTGGTCATGCTTTACTCCTGTATTGTTATTTGTTCATTTCCAATTGATTCTCTACTTTTCCCTTTTT
TGTATTATGTGACTAATTAGTTGGCATATTGTTAAAAGTCTCTCAAATTAGGCCAGATTCTAAAACATGCTGCA
GCAAGAGGACCCCGCTCTCTTCAGGAAAAGTGTTTTCATTTCTCAGGATGCTTCTTACCTGTCAGAGGAGGTGA
CAAGGCAGTCTCTTGCTCTCTTGGACTCACCAGGCTCCTATTGAAGGAACCACCCCCATTCCTAAATATGTGAA
AAGTCGCCCAAAATGCAACCTTGAAAGGCACTACTGACTTTGTTCTTATTGGATACTCCTCTTATTTATTATTT
TTCCATTAAAAATAATAGCTGGCTATTATAGAAATTTAGACCATACAGAGATGTAGAAAGAACATAAATTGTC
CCCATTACCTTAAGGTAATCACTGCTAACAATTTCTGGATGGTTTTTCAAGTCTATTTTTTTTCTATGTATGTC
TCAATTCTCTTTCAAAATTTTACAGAATGTTATCATACTACATATATACTTTTTATGTAAGCTTTTTCACTTAG
TATTTTATCAAATATGTTTTTATTATATTCATAGCCTTCTTAAACATTATATCAATAATTGCATAATAGGCAAC
CTCTAGCGATTACCATAATTTTGCTCATTGAAGGCTATCTCCAGTTGATCATTGGGATGAGCATCTTTGTGCAT
GAATCCTATTGCTGTATTTGGGAAAATTTTCCAAGGTTAGATTCCAATAAATATCTATTTATTATTAAATATTA
AAATATCGATTTATTATTAAAACCATTTATAAGGCTTTTTCATAAATGTATAGCAAATAGGAATTATTAACTTG
AGCATAAGATATGAGATACATGAACCTGAACTATTAAAATAAAATATTATATTTAACCCTAGTTTAAGAAGAAG
TCAATATGCTTATTTAAATATTATGGATGGTGGGCAGATCACTTGAGGTCAGGAGTTCGAGACCAGCCTGGCCA
ACATGGCAAACCACATCTCTACTAAAAATAAAAAAATTAGCTGGGTGTGGTGGTGCACTCCTGTAATCCCAGC
TACTCAGAAGGCTGAGGTACAAGAATTGCTGGAACCTGGGAGGCGGAGGTTGCAGTGAACCAAGATTGCACCAC
TGCACTCCAGCCGGGGTGACAGAGTGAGACTCCGACTGAAAATAAATAAATAAATAAATAAATAAATAAATAAA
TAAATATTATGGATGGTGAAGGGAATGGTATAGAATTGGAGAGATTATCTTACTGAACACCTGTAGTCCCAGCT
TTCTCTGGAAGTGGTGGTATTTGAGCAGGATGTGCACAAGGCAATTGAAATGCCCATAATTAGTTTCTCAGCTT
TGAATACACTATAAACTCAGTGGCTGAAGGAGGAAATTTTAGAAGGAAGCTACTAAAAGATCTAATTTGAAAAA
CTACAAAAGCATTAACTAAAAAGTTTATTTTCCTTTTGTCTGGGCAGTAGTGAAAATAACTACTCACAACATT
CACTATGTTTGCAAGGAATTAACACAAATAAAGATGCCTTTTTACTTAAACGCCAAGACAGAAAACTTGCCCA
ATACTGAGAAGCAACTTGCATTAGAGAGGGAACTGTTAAATGTTTTCAACCCAGTTCATCTGGTGGATGTTTTT
GCAGGTTACTCTGAGAATTTTGCTTATGAAAATCATTATTTTTAGTGTAGTTCACAATAATGTATTGAACATA
CTTCTAATCAAAGGTGCTATGTCCTTGTGTATGGTACTAAATGTGTCCTGTGTACTTTTGCACAACTGAGAATC
CTGCGGCTTGGTTTAATGAGTGTGTTCATGAAATAAATAATGGAGGAATTGTCAAAAAAAAAAAAAAAAAAAAA
AAAAAAAAAAAAAAAAAAAAAAAAAAAAAAAAAAAAAAAA
```

FIGURE 18

```
GAATTCGCCCTTGGCTCAGCATGAGGAACAGAAGGAATGACACTCTGGACAGCACCCGGACCCTGTACTCCAGC
GCGTCTCGGAGCACAGACTTGTCTTACAGTGAAAGCGACTTGGTGAATTTTATTCAAGCAAATTTTAAGAAACG
AGAATGTGTCTTCTTTACCAAAGATTCCAAGGCCACGGAGAATGTGTGCAAGTGTGGCTATGCCCAGAGCCAGC
ACATGGAAGGCACCCAGATCAACCAAAGTGAGAAATGGAACTACAAGAAACACACCAAGGAATTTCCTACCGAC
GCCTTTGGGGATATTCAGTTTGAGACACTGGGGAAGAAAGGGAAGTATATACGTCTGTCCTGCGACACGGACGC
GGAAATCCTTTACGAGCTGCTGACCCAGCACTGGCACCTGAAAACACCCAACCTGGTCATTTCTGTGACCGGGG
GCGCCAAGAACTTCGCCCTGAAGCCGCGCATGCGCAAGATCTTCAGCCGGCTCATCTACATCGCGCAGTCCAAA
GGTGCTTGGATTCTCACGGGAGGCACCCATTATGGCCTGATGAAGTACATCGGGGAGGTGGTGAGAGATAACAC
CATCAGCAGGAGTTCAGAGGAGAATATTGTGGCCATTGGCATAGCAGCTTGGGGCATGGTCTCCAACCGGGACA
CCCTCATCAGGAATTGCGATGCTGAGGGCTATTTTTAGCCCAGTACCTTATGGATGACTTCACAAGAGATCCA
CTGTATATCCTGGACAACAACCACACACATTTGCTGCTCGTGGACAATGGCTGTCATGGACATCCCACTGTCGA
AGCAAAGCTCCGGAATCAGCTAGAGAAGTATATCTCTGAGCGCACTATTCAAGATTCCAACTATGGTGGCAAGA
TCCCCATTGTGTGTTTTGCCCAAGGAGGTGGAAAAGAGACTTTGAAAGCCATCAATACCTCCATCAAAATAAA
ATTCCTTGTGTGGTGGTGGAAGGCTCGGGCCAGATCGCTGATGTGATCGCTAGCCTGGTGGAGGTGGAGGATGC
CCTGACATCTTCTGCCGTCAAGGAGAAGCTGGTGCGCTTTTTACCCCGCACGGTGTCCCGGCTGCCTGAGGAGG
AGACTGAGAGTTGGATCAAATGGCTCAAAGAAATTTCTCAACTTCTCACCTATTAACAGTTATTAAAATGGAA
GAAGCTGGGGATGAAATTGTGAGCAATGCCATCTCCTACGCTCTATACAAAGCCTTCAGCACCAGTGAGCAAGA
CAAGGATAACTGGAATGGGCAGCTGAAGCTTCTGCTGGAGTGGAACCAGCTGGACTTAGCCAATGATGAGATTT
TCACCAATGACCGCCGATGGGAGTCTGCTGACCTTCAAGAAGTCATGTTTACGGCTCTCATAAAGGACAGACCC
AAGTTTGTCCGCCTCTTTCTGGAGAATGGCTTGAACCTACGGAAGTTTCTCACCCATGATGTCCTCACTGAACT
CTTCTCCAACCACTTCAGCACGCTTGTGTACCGGAATCTGCAGATCGCCAAGAATTCCTATAATGATGCCCTCC
TCACGTTTGTCTGGAAACTGGTTGCGAACTTCCGAAGAGGCTTCCGGAAGGAAGACAGAAATGGCCGGGACGAG
ATGGACATAGAACTCCACGACGTGTCTCCTATTACTCGGCACCCCCTGCAAGCTCTCTTCATCTGGGCCATTCT
TCAGAATAAGAAGGAACTCTCCAAAGTCATTTGGGAGCAGACCAGGGGCTGCACTCTGGCAGCCCTGGGAGCCA
GCAAGCTTCTGAAGACTCTGGCCAAAGTGAAGAACGACATCAATGCTGCTGGGGAGTCCGAGGAGCTGGCTAAT
GAGTACGAGACCCGGGCTGTTGAGCTGTTCACTGAGTGTTACAGCAGCGATGAAGACTTGGCAGAACAGCTGCT
GGTCTATTCCTGTGAAGCTTGGGGTGGAAGCAACTGTCTGGAGCTGGCGGTGGAGGCCACAGACCAGCATTTCA
TCGCCCAGCCTGGGGTCCAGAATTTTCTTTCTAAGCAATGGTATGGAGATTTCCCGAGACACCAAGAACTGG
AAGATTATCCTGTGTCTGTTTATTATACCCTTGGTGGGCTGTGGCTTTGTATCATTTAGGAAGAAACCTGTCGA
CAAGCACAAGAAGCTGCTTTGGTACTATGTGGCGTTCTTCACCTCCCCCTTCGTGGTCTTCTCCTGGAATGTGG
TCTTCTACATCGCCTTCCTCCTGCTGTTTGCCTACGTGCTGCTCATGGATTTCCATTCGGTGCCACACCCCCCC
GAGCTGGTCCTGTACTCGCTGGTCTTTGTCCTCTTCTGTGATGAAGTGAGACAGTGGTACGTAAATGGGGTGAA
TTATTTTACTGACCTGTGGAATGTGATGGACACGCTGGGGCTTTTTTACTTCATAGCAGGAATTGTATTTCGGC
TCCACTCTTCTAATAAAAGCTCTTTGTATTCTGGACGAGTCATTTTCTGTCTGGACTACATTATTTTCACTCTA
AGATTGATCCACATTTTTACTGTAAGCAGAAACTTAGGACCCAAGATTATAATGCTGCAGAGGATGCTGATCGA
TGTGTTCTTCTTCCTGTTCCTCTTTGCGGTGTGGATGGTGGCCTTTGGCGTGGCCAGGCAAGGGATCCTTAGGC
AGAATGAGCAGCGCTGGAGGTGGATATTCCGTTCGGTCATCTACGAGCCCTACCTGGCCATGTTCGGCCAGGTG
CCCAGTGACGTGGATGGTACCACGTATGACTTTGCCCACTGCACCTTCACTGGGAATGAGTCCAAGCCACTGTG
TGTGGAGCTGGATGAGCACAACCTGCCCCGGTTCCCCGAGTGGATCACCATCCCCCTGGTGTGCATCTACATGT
TATCCACCAACATCCTGCTGGTCAACCTGCTGGTCGCCATGTTTGGCTACACGGTGGGCACCGTCCAGGAGAAC
AATGACCAGGTCTGGAAGTTCCAGAGGTACTTCCTGGTGCAGGAGTACTGCAGCCGCCTCAATATCCCCTTCCC
CTTCATTGTCTTCGCTTACTTCTACATGGTGGTGAAGAAGTGCTTCAAGTGTTGCTGCAAGGAGAAAAACATGG
AGTCTTCTGTCTGCTGTTTCAAAAATGAAGACAATGAGACTCTGGCATGGGAGGGTGTCATGAAGGAAAACTAC
CTTGTCAAGATCAACACAAAAGCCAACGACACCTCAGAGGAAATGAGGCATCGATTTAGACAACTGGATACAAA
GCTTAATGATCTCAAGGGTCTTCTGAAAGAGATTGCTAATAAAATCAAATAAAACTGTATGAACTCTAATGGAG
AAAAATCTAATTATAGCAAGATCATATTAAGGAATGCTGATGAACAATTTTGCTATCGACTACTAAATGAGAGA
TTTTCAGACCCCTGGGTACATGGTGGATGATTTTAAATCACCCTAGTGTGCTGAGACCTTGAGAATAAAGTGTG
TGATTGGTTTCATACTTGAAGACGGATATAAAGGAAGAATATTTCCTTTATGTGTTTCTCCAGAATGGTGCCTG
TTTCTCTCTGTGTCTCAATGCCTGGGACTGGAGGTTGATAGTTTAAGTGTGTTCTTACCGCCTCCTTTTTCCTT
TAATCTTATTTTTGATGAACACATATATAGGAGAACATCTATCCTATGAATAAGAACCTGGTCATGCTTTAAAA
AAAAAAAAAAAAAAAAAAAAAAAAAAAAAAAAAAAAAAA
```

FIGURE 19

```
GCGGCGGGGGCGAGGTGAGGTGTTGGCAGTGGAAAGGGGTTCGGGCTCGGGGGGCGGGGGGACGCGGAGCGGAT
GGCCCGCGCCGGCCGCAGGGGCGGATAAAAAGCCGTCGCGCTGCGGGAGTGGGCGGGAGGGAGAGGGGGTGTCC
GAGGGCCACAAGAGTATGACGGGGCTGTACGAGCTGGTGTGGCGGGTGCTGCACGCGCTGCTCTGTCTGCACCG
CACGCTCACCTCCTGGCTCCGCGTTCGGTTCGGCACCTGGAACTGGATCTGGCGGCGCTGCTGCCGCGCCGCCT
CTGCCGCGGTCCTAGCGCCGCTCGGCTTCACGCTCCGCAAGCCCCCCGGCAGTCGGCAGGAACCGCCGTCACCAC
CGGCACCCGCCGGGGGGTCGTGCCTGGCAGCCGCACACCACCGGATGCGCTGGCGCGCGGACGGTCGTTCCTT
GGAGAAGCTGCCTGTGCATATGGGCCTGGTGATCACCGAGGTGGAGCAGGAACCCAGCTTCTCGGACATCGCGA
GCCTCGTGGTGTGGTGTATGGCCGTGGGCATCTCCTACATTAGCGTCTACGACCACCAAGGTATTTTCAAAAGA
AATAATTCCAGATTGATGGATGAAATTTTAAAACAACAGCAAGAACTTCTGGGCCTAGATTGTTCAAAATACTC
ACCAGAATTTGCAAATAGTAATGACAAAGATGATCAAGTTTTAAATTGCCATTTGGCAGTGAAGGTGCTGTCTC
CGGAAGATGGAAAAGCAGATATTGTAAGAGCTGCTCAGGACTTTTGCCAGTTAGTAGCCCAGAAGCAAAGGAGA
CCCACAGATTTGGATGTAGATACGTTAGCCAGTTTACTTAGTTCAAATGGTTGTCCTGATCCTGATTTAGTATT
GAAGTTCGGTCCTGTGGACAGCACATTAGGCTTTCTTCCCTGGCACATCAGATTGACTGAGATTGTCTCTTTGC
CTTCCCACCTAAACATCAGTTATGAGGACTTTTTCTCTGCCCTTCGTCAATATGCAGCCTGTGAACAGCGTCTG
GGAAAGTAGTGGTCATTGGTTGCATAATTTGATTTGAGGCTTGTGGAGGAAAGGAACCAAGTGACTCTGATGTT
TACAAAGCACCTATGAAACCCTGTACACACCTATGAAACCCTGTACACACCTAGTTCATAATCCTCATAATTTA
TCAACAAACACAAAGAAGTGTCTTACTTGAGAGTGAGTGTGTGCGTGTGTGCGTGCACACATGTGCACGTTTGT
ATGTGTGGAAATAAACATAAATGGGGACGTGTTGGAGAAGGAAATACATAGACCTACAACTTTGAGCATATAGC
AGTGATGTTTTAGGAACTGAAATGTCACACTTAATAAAGTCTTCAGCCCAGCTACTTCCCTGTTTTCGTGGGGA
GAAGGGGGCCTGATTAGAACTGTTCTGGTTGTGTTTGGCGGGAGGGGAATAAATTTTGTTCAGTCCTTCTTAGT
GACCAAACTTTAATTTTTAGGAATAACATATTGACTTACTGAACTGAAGCATTCTGAGTTGAAAGGAGCCCCAG
AGGAAAGGAGTTCTGTGTTGCTCACATGTTAAAAGCTTGCTCACCTTCAGAGCAGAGGGAATACCTATCTTCAG
ATATCCGCCCATTTTCATCTCTTCATTATAGTCAAACAGTGTGACTTGAGAGTGTTGCTCTGGTGTCTGTATTC
TGGCTTATGAAGATTATTTGAAAAGAACTCTTACTACATTGAAATGCAGACTTTTAAAAATTTAAATATTGGA
TTAGGCAGTCAAAAAACCAAACAAGCATAAAAGGTCAGTAAGTTGTAATCTTAAAAGTAAAGGTGGAAAACTCA
TTATAAATGGAAGAAAAGTTTTGATTTCCTTTTTTGTTTGATGGGCAGTATGCCATATTATATCCAAAGTTGGT
TTAAAAAATACTTCCATCAACTATTTTTATTTAAAATAAACATTTGAGGGAAGTTACCAAGGCAGCTTTTTTCC
TCAAAAGTAACCTGTTCCTCTTTGGAACAGCACATTTTAGGGGCATGGTTAATACCTGAGATTTTTACTCAGTA
AACCTGATGGTTACCGTGTGTAAAATATCTTTAAGTAGGATTGAAGGCCTCTGTGGGGAATATAATGTTACCAA
AGCCTATAAAAATAAATTTTACATGTTCTTTTTTATGACAGAGAGCAGCACTGGTTCTGTTATTTTTTAAAATG
AATAACTGATTTCTTGACAGGTGTTTAGTATTTCTTCCCTCACTGCTGATTCTTGGATAGAAACCATTCTTTAT
ATTTGATAGACTGTTTTCAGAAAACTCTTATCAACAAGTGTACAATAGTTATCTAAAACTGTACATTTAGAATG
GAGCAGTTTAATACTAGATCTCAGAAATTTGAAAATAGCAAAGAAGACTGGATTTGGAAAGCATGGTCTACAA
TTGCTTGTCAATTCTGAAGCTATGAAGAATAAATGTTTCAGCTTTGGATTATGAAACCCGTTTATGATTTTTA
AAACACACTTGAAATAAAAATGATTGAACTAAATTTTGGTCCGGTGACATCATTTTGCACTGCATAGCCCATTA
TACATTGTAAGTCTTTTTGTTTTAATTTATTACTGAGAGTTTTCTGTGAAGCTACAGCATATCTAATCAGAGAA
TTTCTGATTTGTTTCCTTATACTGTGATTATGTTATATTAAGGCATTTGTAGTGCAGCTTAAGACTGAATTTAT
GCTTTTTGTAAACATGATCGGTGTAAATGTCTTATAAACATTCTGGAGTATGTATAACTTTAATGAATGAAATT
TAATGGACCTGATTAAAATAAAGGGATTTAATCTTTGTTAAAGTGAAGTTAGTGGAATAAATTACCTACTGGAA
TATAGTCCAAGTCACTAAAGGTTTAATATTTGCATTTTTGTGCTTTTATTTTCTCCTTCCATTCATAATTATAT
ACTTGAAAGTACATCTGTAGCCTATGACTTGAGTCTCTTGAACTTCTAGGAAGAGGCAAACTACAAACTACTAG
GATTCTGATTTCAGATATAGGCATTCCAGAATCTTCTCTTTACGAGTTCACCTGCTAGTATAATCTCCACAACT
TGAATGGCCTTGGTTGTTCTGTAATTGCTGCCAAAATCATCACAAGCTGTACGTCATCAAGGCTCCCTTTGCAC
TCCCAAGAAGAACTGTTCATTTTAAACAAAAGTGTATGTCTTTATTTGTATTGGAAAATATTGTCTTTAAATTG
TTTCTTGTGACACTTCCCACAATGGAAAAATTACCAAATTAAACCTGTTTTATGGATGGCAGCTTGGAGCATA
GCAAGAATTTGGAGGATTTGAATTCCATTCCCAGTTCTCATTGCGTTTTGTTTCTTAAAACTATAATAATTGGT
TACTGTTATAAAGTTTAAAAGGTGGTTTTAATATGAATAGCAAATTCTGGTATATTGTGACTAACGCTTAAGAA
TGCCTGTCTTTGAGAGGAAGGTGTTATAATATTAATCAACAGTGCCAAATACACTGTGCATATCTACAATTTAA
TCTTTGAATGTTTGTTACTGGATTAGCTCCCTCCTCCTTCTGTGTGATGGTACCATGCATAGAGTCAATCAAAT
CCTTGTGATGTTTTGTATGGACTTTGACAACATGTAACTAATGTGTAAAGCAAGTTTTTATGATTAAGGAATCA
AATTTATTGAATTTTATTATTGAAAGTTGAAACTTAACATGTATAAACAAAAAACAATAAAATAATAAACTATT
TTCATTGACTATAAAAAAAGCCCACGCGTCCGCC
```

FIGURE 20

```
GAGGTGAGGTGTTGGCAGTGGAAAGGGGTTCGGGCTCGGGGGGCGGGGGGACGCGGAGCGATGGCCCGCGCCGG
CCGCAGGGGCGGATAAAAAGCCGTCGCGCTGCGGGAGTGGGCGGGAGGGAGAGGGGGTGTCCGAGGGCCACAAG
AGTATGACGGGGCTGTACGAGCTGGTGTGGCGGGTGCTGCACGCGCTGCTCTGTCTGCACCGCACGCTCACCTC
CTGGCTCCGCGTTCGGTTCGGCACCTGGAACTGGATCTGGCGGCGCTGCTGCCGCGCCGCCTCTGCCGCGGTCC
TAGCGCCGCTCGGCTTCACGCTCCGCAAGCCCCGGCAGTCGGCAGGAACCGCCGTCACCACCGGCACCCGCGC
GGGGGGTCGTGCCTGGCAGCCGCACACCACCGGATGCGCTGGCGCGCGGACGGTCGTTCCTTGGAGAAGCTGCC
TGTGCATATGGGCCTGGTGATCACCGAGGTGGAGCAGGAACCCAGCTTCTCGGACATCGCGAGCCTCGTGGTGT
GGTGTATGGCCGTGGGCATCTCCTACATTAGCGTCTACGACCACCAAGGTATTTTCAAAAGAAATAATTCCAGA
TTGATGGATGAAATTTTAAAACAACAGCAAGAACTTCTGGGCCTAGATTGTTCAAAATACTCACCAGAATTTGC
AAATAGTAATGACAAAGATGATCAAGTTTTAAATTGCCATTTGGCAGTGAAGGTGCTGTCTCCGGAAGATGGAA
AAGCAGATATTGTAAGAGCTGCTCAGGACTTTTGCCAGTTAGTAGCCCAGAAGCAAAAGAGACCCACAGATTTG
GATGTAGATACGTTAGCCAGTTTACTTAGTTCAAATGGTTGTCCTGATCCTGATTTAGTATTGAAGTTCGGTCC
TGTGGACAGCACATTAGGCTTTCTTCCCTGGCACATCAGATTGACTGAGATTGTCTCTTTGCCTTCCCACCTAA
ACATCAGTTATGAGGACTTTTTCTCTGCCCTTCGTCAATATGCAGCCTGTGAACAGCGTCTGGGAAAGTAGTGG
TCATTGGTTGCA
```

FIGURE 21

```
GGGGGGCGGAACCAGCCTGCACGCGCTGGCTCCGGGTGACAGCCGCGCGCCTCGGCCAGGATCTGAGTGATGAG
ACGTGTCCCCACTGAGGTGCCCCACAGCAGCAGGTGTTGAGCATGGGCTGAGAAGCTGGACCGGCACCAAAGGG
CTGGCAGAAATGGGCGCCTGGCTGATTCCTAGGCAGTTGGCGGCAGCAAGGAGGAGAGGCCGCAGCTTCTGGAG
CAGAGCCGAGACGAAGCAGTTCTGGAGTGCCTGAACGGCCCCTGAGCCCTACCCGCCTGGCCCACTATGGTCC
AGAGGCTGTGGGTGAGCCGCCTGCTGCGGCACCGGAAAGCCCAGCTCTTGCTGGTCAACCTGCTAACCTTTGGC
CTGGAGGTGTGTTTGGCCGCAGGCATCACCTATGTGCCGCCTCTGCTGCTGGAAGTGGGGGTAGAGGAGAAGTT
CATGACCATGGTGCTGGGCATTGGTCCAGTGCTGGGCCTGGTCTGTGTCCCGCTCCTAGGCTCAGCCAGTGACC
ACTGGCGTGGACGCTATGGCCGCCGCCGGCCCTTCATCTGGGCACTGTCCTTGGGCATCCTGCTGAGCCTCTTT
CTCATCCCAAGGGCCGGCTGGCTAGCAGGGCTGCTGTGCCCGGATCCCAGGCCCCTGGAGCTGGCACTGCTCAT
CCTGGGCGTGGGGCTGCTGGACTTCTGTGGCCAGGTGTGCTTCACTCCACTGGAGGCCCTGCTCTCTGACCTCT
TCCGGGACCCGGACCACTGTCGCCAGGCCTACTCTGTCTATGCCTTCATGATCAGTCTTGGGGGCTGCCTGGGC
TACCTCCTGCCTGCCATTGACTGGGACACCAGTGCCCTGGCCCCCTACCTGGGCACCCAGGAGGAGTGCCTCTT
TGGCCTGCTCACCCTCATCTTCCTCACCTGCGTAGCAGCCACACTGCTGGTGGCTGAGGAGGCAGCGCTGGGCC
CCACCGAGCCAGCAGAAGGGCTGTCGGCCCCTCCTTGTCGCCCACTGCTGTCCATGCCGGGCCCGCTTGGCT
TTCCGGAACCTGGGCGCCCTGCTTCCCCGGCTGCACCAGCTGTGCTGCCGCATGCCCCGCACCCTGCGCCGGCT
CTTCGTGGCTGAGCTGTGCAGCTGGATGGCACTCATGACCTTCACGCTGTTTTACACGGATTTCGTGGGCGAGG
GGCTGTACCAGGGCGTGCCCAGAGCTGAGCCGGGCACCGAGGCCCGGAGACACTATGATGAAGGCGTTCGGATG
GGCAGCCTGGGGCTGTTCCTGCAGTGCGCCATCTCCCTGGTCTTCTCTCTGGTCATGGACCGGCTGGTGCAGCG
ATTCGGCACTCGAGCAGTCTATTTGGCCAGTGTGGCAGCTTTCCCTGTGGCTGCCGGTGCCACATGCCTGTCCC
ACAGTGTGGCCGTGGTGACAGCTTCAGCCGCCCTCACCGGGTTCACCTTCTCAGCCCTGCAGATCCTGCCCTAC
ACACTGGCCTCCCTCTACCACCGGGAGAAGCAGGTGTTCCTGCCCAAATACCGAGGGGACACTGGAGGTGCTAG
CAGTGAGGACAGCCTGATGACCAGCTTCCTGCCAGGCCCTAAGCCTGGAGCTCCCTTCCCTAATGGACACGTGG
GTGCTGGAGGCAGTGGCCTGCTCCCACCTCCACCCGCGCTCTGCGGGGCCTCTGCCTGTGATGTCTCCGTACGT
GTGGTGGTGGGTGAGCCCACCGAGGCCAGGGTGGTTCCGGGCCGGGGCATCTGCCTGGACCTCGCCATCCTGGA
TAGTGCCTTCCTGCTGTCCCAGGTGGCCCCATCCCTGTTTATGGGCTCCATTGTCCAGCTCAGCCAGTCTGTCA
CTGCCTATATGGTGTCTGCCGCAGGCCTGGGTCTGGTCGCCATTTACTTTGCTACACAGGTAGTATTTGACAAG
AGCGACTTGGCCAAATACTCAGCGTAGAAAACTTCCAGCACATTGGGGTGGAGGGCCTGCCTCACTGGGTCCCA
GCTCCCCGCTCCTGTTAGCCCCATGGGGCTGCCGGGCTGGCCGCCAGTTTCTGTTGCTGCCAAAGTAATGTGGC
TCTCTGCTGCCACCCTGTGCTGCTGAGGTGCGTAGCTGCACAGCTGGGGGCTGGGGCGTCCCTCTCCTCTCTCC
CCAGTCTCTAGGGCTGCCTGACTGGAGGCCTTCCAAGGGGGTTTCAGTCTGGACTTATACAGGGAGGCCAGAAG
GGCTCCATGCACTGGAATGTGGGGACTCTGCAGGTGGATTACCCAGGCTCAGGGTTAACAGCTAGCCTCCTAGT
TGAGACACACCTAGAGAAGGGTTTTTGGGAGCTGAATAAACTCAGTCACCTGGTTTCCCATCTCTAAGCCCCTT
AACCTGCAGCTTCGTTTAATGTAGCTCTTGCATGGGAGTTTCTAGGATGAAACACTCCTCCATGGGATTTGAAC
ATATGAAAGTTATTTGTAGGGAAGAGTCCTGAGGGGCAACACACAAGAACCAGGTCCCCTCAGCCCACAGCAC
TGTCTTTTTGCTGATCCACCCCCCTCTTACCTTTTATCAGGATGTGGCCTGTTGGTCCTTCTGTTGCCATCACA
GAGACACAGGCATTTAAATATTTAACTTATTTATTTAACAAAGTAGAAGGGAATCCATTGCTAGCTTTTCTGTG
TTGGTGTCTAATATTTGGGTAGGGTGGGGGATCCCCAACAATCAGGTCCCCTGAGATAGCTGGTCATTGGGCTG
ATCATTGCCAGAATCTTCTTCTCCTGGGGTCTGGCCCCCAAAATGCCTAACCCAGGACCTTGGAAATTCTACT
CATCCCAAATGATAATTCCAAATGCTGTTACCCAAGGTTAGGGTGTTGAAGGAAGGTAGAGGGTGGGGCTTCAG
GTCTCAACGGCTTCCCTAACCACCCCTCTTCTCTTGGCCCAGCCTGGTTCCCCCCACTTCCACTCCCCTCTACT
CTCTCTAGGACTGGGCTGATGAAGGCACTGCCCAAAATTTCCCCTACCCCCAACTTTCCCCTACCCCCAACTTT
CCCCACCAGCTCCACAACCCTGTTTGGAGCTACTGCAGGACCAGAAGCACAAAGTGCGGTTTCCCAAGCCTTTG
TCCATCTCAGCCCCCAGAGTATATCTGTGCTTGGGGAATCTCACACAGAAACTCAGGAGCACCCCCTGCCTGAG
CTAAGGGAGGTCTTATCTCTCAGGGGGGTTTAAGTGCCGTTTGCAATAATGTCGTCTTATTTATTTAGCGGGGT
GAATATTTTATACTGTAAGTGAGCAATCAGAGTATAATGTTTATGGTGACAAAATTAAAGCCTTTCTTATATGTTT
```

FIGURE 22

```
AACAAAAGCTGGAGCTCCACCGCGGTGGCGGCCGCTCTAGCCCCTGGTTCGGCCCACCTCTGAAGGTTCCAGAA
TCGATAGTGAATTCGTGGGGAAGCGCAGCCATGGCTCTGCGGAGGCTGGGGGCCGCGCTGCTGCTGCCGCT
GCTCGCCGCCGTGGAAGAAACGCTAATGGACTCCACTACAGCGACTGCTGAGCTGGGCTGGATGGTGCATCCTC
CATCAGGGTGGGAAGAGGTGAGTGGCTACGATGAGAACATGAACACGATCCGCACGTACCAGGTGTGCAACGTG
TTTGAGTCAAGCCAGAACAACTGGCTACGGACCAAGTTTATCCGGCGCCGTGGCGCCCACCGCATCCACGTGGA
GATGAAGTTTTCGGTGCGTGACTGCAGCAGCATCCCCAGCGTGCCTGGCTCCTGCAAGGAGACCTTCAACCTCT
ATTACTATGAGGCTGACTTTGACTCGGCCACCAAGACCTTCCCCAACTGGATGGAGAATCCATGGGTGAAGGTG
GATACCATTGCAGCCGACGAGAGCTTCTCCCAGGTGGACCTGGGTGGCCGCGTCATGAAAATCAACACCGAGGT
GCGGAGCTTCGGACCTGTGTCCCGCAGCGGCTTCTACCTGGCCTTCCAGGACTATGGCGGCTGCATGTCCCTCA
TCGCCGTGCGTGTCTTCTACCGCAAGTGCCCCCGCATCATCCAGAATGGCGCCATCTTCCAGGAAACCCTGTCG
GGGGCTGAGAGCACATCGCTGGTGGCTGCCCGGGGCAGCTGCATCGCCAATGCGGAAGAGGTGGATGTACCCAT
CAAGCTCTACTGTAACGGGGACGGCGAGTGGCTGGTGCCCATCGGGCGCTGCATGTGCAAAGCAGGCTTCGAGG
CCGTTGAGAATGGCACCGTCTGCCGAGGTTGTCCATCTGGGACTTTCAAGGCCAACCAAGGGGATGAGGCCTGT
ACCCACTGTCCCATCAACAGCCGGACCACTTCTGAAGGGGCCACCAACTGTGTCTGCCGCAATGGCTACTACAG
AGCAGACCTGGACCCCTGGACATGCCCTGCACAACCATCCCCTCCGCGCCCAGGCTGTGATTTCCAGTGTCA
ATGAGACCTCCCTCATGCTGGAGTGGACCCCTCCCCGCGACTCCGGAGGCCGAGAGGACCTCGTCTACAACATC
ATCTGCAAGAGCTGTGGCTCGGGCCGGGGTGCCTGCACCCGCTGCGGGGACAATGTACAGTACGCACCACGCCA
GCTAGGCCTGACCGGACCACGCATTTACATCAGTGACTGCTGGCCCACACCCAGTACACCTTCGAGATCCAGG
CTGTGAACGGCGTTACTGACCAGAGCCCCTTCTCGCCTCAGTTCGCCTCTGTGAACATCACCACCAACCAGGCA
GCTCCATCGGCAGTGTCCATCATGCATCAGGTGAGCCGCACCGTGGACAGCATTACCCTGTCGTGGTCCCAGCC
AGACCAGCCCAATGGCGTGATCCTGGACTATGAGCTGCAGTACTATGAGAAGGAGCTCAGTGAGTACAACGCCA
CAGCCATAAAAAGCCCCACCAACACGGTCACCGTGCAGGGCCTCAAAGCCGGCGCCATCTATGTCTTCCAGGTG
CGGGCACGCACCGTGGCAGGCTACGGGCGCTACAGCGGCAAGATGTACTTCCAGACCATGACAGAAGCCGAGTA
CCAGACAAGCATCCAGGAGAAGTTGCCACTCATCATCGGCTCCTCGGCCGCTGGCCTGGTCTTCCTCATTGCTG
TGGTTGTCATCGCCATCGTGTGTAACAGAAGACGGGGTTTGAGCGTGCTGACTCGGAGTACACGGACAAGCTG
CAACACTACACCAGTGGCCACATGACCCCAGGCATGAAGATCTACATCGATCCTTTCACCTACGAGGACCCCAA
CGAGGCAGTGCGGGAGTTTGCCAAGGAAATTGACATCTCCTGTGTCAAAATTGAGCAGGTGATCGGAGCAGGGG
AGTTTGGCGAGGTCTGCAGTGGCCACCTGAAGCTGCCAGGCAAGAGAGAGATCTTTGTGGCCATCAAGACGCTC
AAGTCGGGCTACACGGAGAAGCAGCGCCGGGACTTCCTGAGCGAAGCCTCCATCATGGGCCAGTTCGACCATCC
CAACGTCATCCACCTGGAGGGTGTCGTGACCAAGAGCACACCTGTGATGATCATCACCGAGTTCATGGAGAATG
GCTCCCTGGACTCCTTTCTCCGGCAAAACGATGGGCAGTTCACAGTCATCCAGCTGGTGGGCATGCTTCGGGGC
ATCGCAGCTGGCATGAAGTACCTGGCAGACATGAACTATGTTCACCGTGACCTGGCTGCCCGCAACATCCTCGT
CAACAGCAACCTGGTCTGCAAGGTGTCGGACTTTGGGCTCTCACGCGTTTCTAGAGGACGATACCTCAGACCCA
CCTACACCAGTGCCCTGGGCGGAAAGATCCCCATCCGCTGGACAGCCCCGGAAGCCATCCAGTACCGGAAGTTC
ACCTCGGCCAGTGATGTGTGGAGCTACGGCATTGTCATGTGGGAGGTGATGTCCTATGGGGAGCGGCCCTACTG
GGACATGACCAACCAGGATGTAATCAATGCCATTGAGCAGGACTATCGGCTGCCACCGCCCATGGACTGCCCGA
GCGCCCTGCACCAACTCATGCTGGACTGTTGGCAGAAGGACCGCAACCACCGGCCCAAGTTCGGCCAAATTGTC
AACACGCTAGACAAGATGATCCGCAATCCCAACAGCCTCAAAGCCATGGCGCCCCTCTCCTCTGGCATCAACCT
GCCGCTGCTGGACCGCACGATCCCCGACTACACCAGCTTTAACACGGTGGACGAGTGGCTGGAGGCCATCAAGA
TGGGGCAGTACAAGGAGAGCTTCGCCAATGCCGGCTTCACTTCCTTGACGTCGTCTCAGATGATGATGAG
GACATTCTCCGGGTTGGGCTCACTTTGGCTGGCCACCAGAAAAAAATCCTGAACAGTATCCAGGTGATGCGGGC
GCAGATGAACCAGATTCAGTCTGTGGAGGTTTGACATTCACCTGCCTCGGCTCACCTCTTCCTCCAAGCCCCGC
CCCCTCTGCCCCACGTGCCGGCCCTCCTGGTGCTCTATCCACTGCAGGGCCAGCCACTCGCCAGGAGGCCACGG
GCCACGGGAAGAACCAAGCGGTGCCAGCCACGAGACGTCACCAAGAAAACATGCAACTCAAACGACGGAAAAAA
AAAGGGAATGGGAAAAAAGAAAACAGATCCTGGGAGGGGCGGGAAATACAAGGAATATTTTTAAAGAGGATT
CTCATAAGGAAAGCAATGACTGTTCTTGCGGGGATAAAAAAGGGCTTGGGAGATTCATGCGATGTGTCCAATC
GGAGACAAAAGCAGTTTCTCTCCAACTCCCTCTGGGAAGGTGACCTGGCCAGAGCCAAGAAACACTTTCAGAAA
AACAAATGTGAAGGGGAGAGACAGGGGCCGCCCTTGGCTCCTGTCCCTGCTGCTCCTCACTCAACA
ACCAAGCGCCTGGAGGACGGGACAGATGGACAGACAGCCACCCTGAGAACCCCTCTGGGAAAATCTATTCCTGC
CACCACTGGGCAAACAGAAGAATTTTTCTGTCTTTGGAGAGTATTTTAGAAACTCCAATGAAAGACACTGTTTC
TCCTGTTGGCTCACAGGGCTGAAAGGGGCTTTTGTCCTCCTGGGTCAGGGAGAACGCGGGGACCCCAG
```

FIGURE 23

```
CGGGAAGCGCAGCCATGGCTCTGCGGAGGCTGGGGGCCGCGCTGCTGCTGCTGCCGCTGCTCGCCGCCGTGGAA
GAAACGCTAATGGACTCCACTACAGCGACTGCTGAGCTGGGCTGGATGGTGCATCCTCCATCAGGGTGGGAAGA
GGTGAGTGGCTACGATGAGAACATGAACACGATCCGCACGTACCAGGTGTGCAACGTGTTTGAGTCAAGCCAGA
ACAACTGGCTACGACCAAGTTTATCCGGCGCCGTGGCGCCCACCGCATCCACGTGGAGATGAAGTTTTCGGTG
CGTGACTGCAGCAGCATCCCCAGCGTGCCTGGCTCCTGCAAGGAGACCTTCAACCTCTATTACTATGAGGCTGA
CTTTGACTCGGCCACCAAGACCTTCCCCAACTGGATGGAGAATCCATGGGTGAAGGTGGATACCATTGCAGCCG
ACGAGAGCTTCTCCCAGGTGGACCTGGGTGGCCGCGTCATGAAAATCAACACCGAGGTGCGGAGCTTCGGACCT
GTGTCCCGCAGCGGCTTCTACCTGGCCTTCCAGGACTATGGCGGCTGCATGTCCCTCATCGCCGTGCGTGTCTT
CTACCGCAAGTGCCCCCGCATCATCCAGAATGGCGCCATCTTCCAGGAAACCCTGTCGGGGCTGAGAGCACAT
CGCTGGTGGCTGCCCGGGGCAGCTGCATCGCCAATGCGGAAGAGGTGGATGTACCCATCAAGCTCTACTGTAAC
GGGGACGGCGAGTGGCTGGTGCCCATCGGGCGCTGCATGTGCAAAGCAGGCTTCGAGGCCGTTGAGAATGGCAC
CGTCTGCCGAGGTTGTCCATCTGGGACTTTCAAGGCCAACCAAGGGGATGAGGCCTGTACCCACTGTCCCATCA
ACAGCCGGACCACTTCTGAAGGGGCCACCAACTGTGTCTGCCGCAATGGCTACTACAGAGCAGACCTGGACCCC
CTGGACATGCCCTGCACAACCATCCCCTCCGCGCCCAGGCTGTGATTTCCAGTGTCAATGAGACCTCCCTCAT
GCTGGAGTGGACCCCTCCCCGCGACTCCGGAGGCCGAGAGGACCTCGTCTACAACATCATCTGCAAGAGCTGTG
GCTCGGGCCGGGGTGCCTGCACCCGCTGCGGGGACAATGTACAGTACGCACCACGCCAGCTAGGCCTGACCGAG
CCACGCATTTACATCAGTGACCTGCTGGCCCACACCCAGTACACCTTCGAGATCCAGGCTGTGAACGGCGTTAC
TGACCAGAGCCCCTTCTCGCCTCAGTTCGCCTCTGTGAACATCACCACCAACCAGGCAGCTCCATCGGCAGTGT
CCATCATGCATCAGGTGAGCCGCACCGTGGACAGCATTACCCTGTCGTGGTCCCAGCCGGACCAGCCCAATGGC
GTGATCCTGGACTATGAGCTGCAGTACTATGAGAAGGAGCTCAGTGAGTACAACGCCACAGCCATAAAAAGCCC
CACCAACACGGTCACCGTGCAGGGCCTCAAAGCCGGCGCCATCTATGTCTTCCAGGTGCGGGCACGCACCGTGG
CAGGCTACGGGCGCTACAGCGGCAAGATGTACTTCCAGACCATGACAGAAGCCGAGTACCAGACAAGCATCCAG
GAGAAGTTGCCACTCATCATCGGCTCCTCGGCCGCTGGCCTGGTCTTCCTCATTGCTGTGGTTGTCATCGCCAT
CGTGTGTAACAGACGGGGGTTTGAGCGTGCTGACTCGGAGTACACGGACAAGCTGCAACACTACACCAGTGGCC
ACATGACCCCAGGCATGAAGATCTACATCGATCCTTTCACCTACGAGGACCCCAACGAGGCAGTGCGGGAGTTT
GCCAAGGAAATTGACATCTCCTGTGTCAAAATTGAGCAGGTGATCGGAGCAGGGGAGTTTGGCGAGGTCTGCAG
TGGCCACCTGAAGCTGCCAGGCAAGAGAGAGATCTTTGTGGCCATCAAGACGCTCAAGTCGGGCTACACGGAGA
AGCAGCGCCGGGACTTCCTGAGCGAAGCCTCCATCATGGGCCAGTTCGACCATCCCAACGTCATCCACCTGGAG
GGTGTCGTGACCAAGAGCACACCTGTGATGATCATCACCGAGTTCATGGAGAATGGCTCCCTGGACTCCTTTCT
CCGGCAAAACGATGGGCAGTTCACAGTCATCCAGCTGGTGGGCATGCTTCGGGGCATCGCAGCTGGCATGAAGT
ACCTGGCAGACATGAACTATGTTCACCGTGACCTGGCTGCCCGCAACATCCTCGTCAACAGCAACCTGGTCTGC
AAGGTGTCGGACTTTGGGCTCTCACGCTTTCTAGAGGACGATACCTCAGACCCCACCTACACCAGTGCCCTGGG
CGGAAAGATCCCCATCCGCTGGACAGCCCCGGAAGCCATCCAGTACCGGAAGTTCACCTCGGCCAGTGATGTGT
GGAGCTACGGCATTGTCATGTGGGAGGTGATGTCCTATGGGGAGCGGCCCTACTGGGACATGACCAACCAGGAT
GTAATCAATGCCATTGAGCAGGACTATCGGCTGCCACCGCCCATGGACTGCCCGAGCGCCCTGCACCAACTCAT
GCTGGACTGTTGGCAGAAGGACCGCAACCACCGGCCCAAGTTCGGCCAAATTGTCAACACGCTAGACAAGATGA
TCCGCAATCCCAACAGCCTCAAAGCCATGGCGCCCCTCTCCTCTGGCATCAACCTGCCGCTGCTGGACCGCACG
ATCCCCGACTACACCAGCTTTAACACGGTGGACGAGTGGCTGGAGGCCATCAAGATGGGGCAGTACAAGGAGAG
CTTCGCCAATGCCGGCTTCACCTCCTTTGACGTCGTGTCTCAGATGATGATGGAGGACATTCTCCGGGTTGGGG
TCACTTTGGCTGGCCACCAGAAAAAAATCCTGAACAGTATCCAGGTGATGCGGGCGCAGATGAACCAGATTCAG
TCTGTGGAGGTTTGACATTCACCTGCCTCGGCTCACCTCTTCCTCCAAGCCCCGCCCCTCTGCCCCACGTGCC
GGCCCTCCTGGTGCTCTATCCACTGCAGGGCCAGCCACTCGCCAGGAGGCCACGGGCCACGGGAAGAACCAAGC
GGTGCCAGCCACGAGACGTCACCAAGAAAACATGCAACTCAAACGACGGAAAAAAAAGGGAATGGGAAAAAAG
AAAACAGATCCTGGGAGGGGGCGGGAAATACAAGGAATATTTTTAAAGAGGATTCTCATAAGGAAAGCAATGA
CTGTTCTTGCGGGGGATAAAAAAGGGCTTGGGAGATTCATGCGATGTGTCCAATCGGAGACAAAAGCAGTTTCT
CTCCAACTCCCTCTGGGAAGGTGACCTGGCCAGAGCCAAGAAACACTTTCAGAAAAACAAATGTGAAGGGGAGA
GACAGGGGCCGCCCTTGGCTCCTGTCCCTGCTGCTCCTCTAGGCCTCACTCAACAACCAAGCGCCTGGAGGACG
GGACAGATGGACAGACAGCCACCCTGAGAACCCTCTGGGAAATCTATTCCTGCCACCACTGGGCAAACAGAA
GAATTTTTCTGTCTTTGGAGAGTATTTTAGAAACTCCAATGAAAGACACTGTTTCTCCTGTTGGCTCACAGGGC
TGAAAGGGGCTTTTGTCCTCCTGGGTCAGGGAGAACGCGGGGACCCCAGAAAGGTCAGCCTTCCTGAGGATGGG
CAACCCCCAGGTCTGCAGCTCCAGGTACATATCACGCGCACAGCCTGGCAGCCTGGCCCTCCTGGTGCCCACTC
CCGCCAGCCCCTGCCTCGAGGTCGAC
```

FIGURE 24

CCGCCAGCTCCTTCGGCAATGAACTTCTCCACCAGCAGCAGCAGCTTCGCCTACGACCGGGAGTTCCTCCGCAC
CCTGCCCGGCTTCCTCATCGTGGCCGAGATCGTTCTGGGGCTGCTGGTATGGACGCTTATTGCTGGAACTGAGT
ACTTCCGGGTCCCCGCATTTGGCTGGGTCATGTTTGTAGCTGTATTTTACTGGGTCCTCACCGTCTTCTTCCTC
ATTATCTACATAACAATGACCTACACCAGGATTCCCCAGGTGCCCTGGACAACAGTGGGCCTGTGCTTTAACGG
CAGTGCCTTCGTCTTGTACCTCTCTGCCGCTGTTGTAGATGCATCTTCCGTCTCCCCTGAGAGGGACAGTCACA
ACTTCAACAGCTGGGCGGCCTCATCGTTCTTTGCCTTCCTGGTCAACATCTGCTACGCTGGAAATACATATTTC
AGTTTTATAGCATGGAGATCCAGGACCATACAGTGATTTACCATTTTGATAATTAAAAGGAAAAAAAAGGAAG
ACTCTCACTGTAAAAACAGCTGTAGGTATAATGTATATTCCCAGAGAATTGTATTTAACTAATTAATGTTTTTT
ATATTCTTAAATTTGCTCACAAATTGTGGTTTGTTACAATTAAACTGGATACTTATTTGCAAAGTGTTGTAGCT
TATAATGAACTCTTAAGTATCTTATTAATGTATTAATGTCTTCATAGATCATATTTTCTTAGACAATGTTTAAA
TAGATAAATTGCTAATATTGAGAATGTGTCAAGTTTGTAAACCTAACTTTTAAGATGCCAGATTCTTTTTTGAT
TAAATGTTGCAAAATCCCAAAAAAAAAAAAAAAAAAAAAA

FIGURE 25

GCCCTTGGCAATGAACTTCTCCACCAGCAGCAGCAGCTTCGCCTACGACCGGGAGTTCCTCCGCACCCTGCCCG
GCTTCCTCATCGTGGCCGAGATCGTTCTGGGGCTGCTGGTATGGACGCTTATTGCTGGAACTGAGTACTTCCGG
GTCCCCGCATTTGGCTGGGTCATGTTTGTAGCTGTATTTTACTGGGTCCTCACCGTCTTCTTCCTCATTATCTA
CATAACAATGACCTACACCAGGATTCCCCAGGTGCCCTGGACAACAGTGGGCCTGTGCTTTAACGGCAGTGCCT
TCGTCTTGTACCTCTCTGCCGCTGTTGTAGATGCATCTTCCGTCTCCCCTGAGAGGGACAGTCACAACTTCAAC
AGCTGGGCGGCCTCATCGTTCTTTGCCTTCCTGGTCACCATCTGCTACGCTGGAAATACATATTTCAGTTTTAT
AGCATGGAGATCCAGGACCATACAGTGATTTACCAAAGGGC

FIGURE 26

```
GGCCCTGCCCTGAAGGCTGGTCACTTGCAGAGGTAAACTCCCCTCTTTGACTTCTGGCCAGGGTTTGTGCTGAG
CTGGCTGCAGCCGCTCTCAGCCTCGCTCCGGGCACGTCGGGCAGCCTCGGGCCCTCCTGCCTGCAGGATCATGC
CCACCACCGTGGACGATGTCCTGGAGCATGGAGGGGAGTTTCACTTTTTCCAGAAGCAAATGTTTTTCCTCTTG
GCTCTGCTCTCGGCTACCTTCGCGCCCATCTACGTGGGCATCGTCTTCCTGGGCTTCACCCCTGACCACCGCTG
CCGGAGCCCCGGAGTGGCCGAGCTGAGTCTGCGCTGCGGCTGGAGTCCTGCAGAGGAACTGAACTACACGGTGC
CGGGCCCAGGACCTGCGGGCGAAGCCTCCCCAAGACAGTGTAGGCGCTACGAGGTGGACTGGAACCAGAGCACC
TTTGACTGCGTGGACCCCCTGGCCAGCCTGGACACCAACAGGAGCCGCCTGCCACTGGGCCCCTGCCGGGACGG
CTGGGTGTACGAGACGCCTGGCTCGTCCATCGTCACCGAGTTTAACCTGGTATGTGCCAACTCCTGGATGTTGG
ACCTATTCCAGTCATCAGTGAATGTAGGATTCTTTATTGGCTCTATGAGTATCGGCTACATAGCAGACAGGTTT
GGCCGTAAGCTCTGCCTCCTAACTACAGTCCTCATAAATGCTGCAGCTGGAGTTCTCATGGCCATTTCCCCAAC
CTATACGTGGATGTTAATTTTTCGCTTAATCCAAGGACTGGTCAGCAAAGCAGGCTGGTTAATAGGCTACATCC
TGATTACAGAATTTGTTGGGCGGAGATATCGGAGAACAGTGGGGATTTTTTACCAAGTTGCCTATACAGTTGGG
CTCCTGGTGCTAGCTGGGGTGGCTTACGCACTTCCTCACTGGAGGTGGTTGCAGTTCACAGTTGCTCTGCCCAA
CTTCTTCTTCTTGCTCTATTACTGGTGCATACCTGAGTCTCCCAGGTGGCTGATCTCCCAGAATAAGAATGCTG
AAGCCATGAGAATCATTAAGCACATCGCAAAGAAAAATGGAAAATCTCTACCCGCCTCCCTTCAGCGCCTGAGA
CTTGAAGAGGAAACTGGCAAGAAATTGAACCCTTCATTTCTTGACTTGGTCAGAACTCCTCAGATAAGGAAACA
TACTATGATATTGATGTACAACTGGTTCACGAGCTCTGTGCTCTACCAGGGCCTCATCATGCACATGGGCCTTG
CAGGTGACAATATCTACCTGGATTTCTTCTACTCTGCCCTGGTTGAATTCCCAGCTGCCTTCATGATCATCCTC
ACCATCGACCGCATCGGACGCCGTTACCCTTGGGCTGCATCAAATATGGTTGCAGGGGCAGCCTGTCTGGCCTC
AGTTTTTATACCTGGTGATCTACAATGGCTAAAAATTATTATCTCATGCTTGGGAAGAATGGGGATCACAATGG
CCTATGAGATAGTCTGCCTGGTCAATGCTGAGCTGTACCCCACATTCATTAGGAATCTTGGCGTCCACATCTGT
TCCTCAATGTGTGACATTGGTGGCATCATCACGCCATTCCTGGTCTACCGGCTCACTAACATCTGGCTTGAGCT
CCCGCTGATGGTTTTCGGCGTACTTGGCTTGGTTGCTGGAGGTCTGGTGCTGTTGCTTCCAGAAACTAAAGGGA
AAGCTTTGCCTGAGACCATCGAGGAAGCCGAAAATATGCAAAGACCAAGAAAAAATAAAGAAAAGATGATTTAC
CTCCAAGTTCAGAAACTAGACATTCCATTGAACTAAGAAGAGAGACCGTTGCTGCTGTCATGACCTAGCTTTGA
TGGCAGCAAGACCAAAAGTAGAAATCCCTGCACTCATCACAAAGCCCATACAACTCAACCAAACTTACCCCTGA
GCCCTATCAACCTAGGTCTACAGCCAGTGGAGTCTATTGTACACTGTGGAAAAATACCCATGGGACCAGATCCT
GCCAAATTCTTCCAGCTCACTTTATTCTCAGCATTCCTAGGACATTGGACATTGGTTTTCTGGAGGGTTTTTTT
TCCGATCTTTGTATTTTTTAAATTTGATTCTTTTCTTTGCAATGCTAGCAACCAGAATACATAGGGGAACTGT
GGGCTAGGCAAANAAAATAGAAAAGTGTGAAAAACAGTAAAGTTGGGAGAGGAGCATCTATTTTCTTAAAGAA
ATAAAACACCNAAAACAAAAAAAAAAAAAAAAAAAAA
```

FIGURE 27

```
GCCCTTCTCCTGCCTGCAGGATCATGCCCACCACCGTGGACGATGTCCTGGAGCATGGAGGGGAGTTTCACTTT
TTCCAGAAGCAAATGTTTTTCCTCTTGGCTCTGCTCTCGGCTACCTTCGCGCCCATCTACGTGGGCATCGTCTT
CCTGGGCTTCACCCCTGACCACCGCTGCCGGAGCCCCGGAGTGGCCGAGCTGAGTCTGCGCTGCGGCTGGAGTC
CTGCAGAGGAACTGAACTACACGGTGCCGGGCCCAGGACCTGCGGGCGAAGCCTCCCCAAGACAGTGTAGGCGC
TACGAGGTGGACTGGAACCAGAGCACCTTCGACTGCGTGGACCCCCTGGCCAGCCTGGACACCAACAGGAGCCG
CCTGCCACTGGGCCCCTGCCGGGACGGCTGGGTGTACGAGACGCCTGGCTCGTCCATCGTCACCGAGTTTAACC
TGGTATGTGCCAACTCCTGGATGTTGGACCTATTCCAGTCATCAGTGAATGTAGGATTCTTTATTGGCTCTATG
AGTATCGGCTACATAGCAGACAGGTTTGGCCGTAAGCTCTGCCTCCTAACTACAGTCCTCATAAATGCTGCAGC
TGGAGTTCTCATGGCCATTTCCCCAACCTATACGTGGATGTTAATTTTTCGCTTAATCCAAGGACTGGTCAGCA
AAGCAGGCTGGTTAATAGGCTACATCCTGATTACAGAATTTGTTGGGCGGAGATATCGGAGAACAGTGGGGATT
TTTTACCAAGTTGCCTATACAGTTGGGCTCCTGGTGCTAGCTGGGGTGGCTTACGCACTTCCTCACTGGAGGTG
GTTGCAGTTCACAGTTTCTCTGCCCAACTTCTTCTTCTTGCTCTATTACTGGTGCATACCTGAGTCTCCCAGGT
GGCTGATCTCCCAGAATAAGAATGCTGAAGCCATGAGAATCATTAAGCACATCGCAAAGAAAAATGGAAAATCT
CTACCCGCCTCCCTTCAGCGCCTGAGACTTGAAGAGGAAACTGGCAAGAAATTGAACCCTTCATTTCTTGACTT
GGTCAGAACTCCTCAGATAAGGAAACATACTATGATATTGATGTACAACTGGTTCACGAGCTCTGTGCTCTACC
AGGGCCTCATCATGCACATGGGCCTTGCAGGTGACAATATCTACCTGGATTTCTTCTACTCTGCCCTGGTTGAA
TTCCCAGCTGCCTTCATGATCATCCTCACCATCGACCGCATCGGACGCCGTTACCCTTGGGCTGCATCAAATAT
GGTTGCAGGGGCAGCCTGTCTGGCCTCAGTTTTTATACCTGGTGATCTACAATGGCTAAAAATTATTATCTCAT
GCTTGGGAAGAATGGGGATCACAATGGCCTATGAGATAGTCTGCCTGGTCAATGCTGAGCTGTACCCCACATTC
ATTAGGAATCTTGGCGTCCACATCTGTTCCTCAATGTGTGACATTGGTGGCATCATCACGCCATTCCTGGTCTA
CCGGCTCACTAACATCTGGCTTGAGCTCCCGCTGATGGTTTTCGGCGTGCTTGGCTTGGTTGCTGGAGGTCTGG
TGCTGTTGCTTCCAGAAACTAAAGGGAAAGCTTTGCCTGAGACCATCGAGGAAGCCGAAAATATGCAAAGACCA
AGAAAAAATAAAGAAAAGATGATTTACCTCCAAGTTCAGAAACTAGACATTCCATTGAACTAAGAAGAGAGACC
GTTGCTGCTGTCATGACAAGGGC
```

FIGURE 28

```
CGGGCCAGGTTTCCAGGCTCGGCCGCCGCCTCCATCCCAGCACCTGCGGAGGGAGCGCTGACCATGGCTCCCTG
GCCTGAATTGGGAGATGCCCAGCCCAACCCCGATAAGTACCTCGAAGGGGCCGCAGGTCAGCAGCCCACTGCCC
CTGATAAAAGCAAAGAGACCAACAAAACAGATAACACTGAGGCACCTGTAACCAAGATTGAACTTCTGCCGTCC
TACTCCACGGCTACACTGATAGATGAGCCCACTGAGGTGGATGACCCCTGGAACCTACCCACTCTTCAGGACTC
GGGGATCAAGTGGTCAGAGAGAGACACCAAAGGGAAGATTCTCTGTTTCTTCCAAGGGATTGGGAGATTGATTT
TACTTCTCGGATTTCTCTACTTTTTCGTGTGCTCCCTGGATATTCTTAGTAGCGCCTTCCAGCTGGTTGGAGGA
AAAATGGCAGGACAGTTCTTCAGCAACAGCTCTATTATGTCCAACCCTTTGTTGGGGCTGGTGATCGGGGTGCT
GGTGACCGTCTTGGTGCAGAGCTCCAGCACCTCAACGTCCATCGTTGTCAGCATGGTGTCCTCTTCATTGCTCA
CTGTTCGGGCTGCCATCCCCATTATCATGGGGGCCAACATTGGAACGTCAATCACCAACACTATTGTTGCGCTC
ATGCAGGTGGGAGATCGGAGTGAGTTCAGAAGAGCTTTTGCAGGAGCCACTGTCCATGACTTCTTCAACTGGCT
GTCCGTGTTGGTGCTCTTGCCCGTGGAGGTGGCCACCCATTACCTCGAGATCATAACCCAGCTTATAGTGGAGA
GCTTCCACTTCAAGAATGGAGAAGATGCCCCAGATCTTCTGAAAGTCATCACTAAGCCCTTCACAAAGCTCATT
GTCCAGCTGGATAAAAAAGTTATCAGCCAAATTGCAATGAACGATGAAAAAGCGAAAAACAAGAGTCTTGTCAA
GATTGGTGCAAAACTTTTACCAACAAGACCCAGATTAACGTCACTGTTCCCTCGACTGCTAACTGCACCTCCC
CTTCCCTCTGTTGGACGGATGGCATCCAAAACTGGACCATGAAGAATGTGACCTACAAGGAGAACATCGCCAAA
TGCCAGCATATCTTTGTGAATTTCCACCTCCCGGATCTTGCTGTGGGCACCATCTTGCTCATACTCTCCCTGCT
GGTCCTCTGTGGTTGCCTGATCATGATTGTCAAGATCCTGGGCTCTGTGCTCAAGGGGCAGGTCGCCACTGTCA
TCAAGAAGACCATCAACACTGATTTCCCCTTTCCCTTTGCATGGTTGACTGGCTACCTGGCCATCCTCGTCGGG
GCAGGCATGACCTTCATCGTACAGAGCAGCTCTGTGTTCACGTCGGCCTTGACCCCCTGATTGGAATCGGCGT
GATAACCATTGAGAGGGCTTATCCACTCACGCTGGGCTCCAACATCGGCACCACCACCACCGCCATCCTGGCCG
CCTTAGCCAGCCCTGGCAATGCATTGAGGAGTTCACTCCAGATCGCCCTGTGCCACTTTTTCTTCAACATCTCC
GGCATCTTGCTGTGGTACCCGATCCCGTTCACTCGCCTGCCCATCCGCATGGCCAAGGGGCTGGGCAACATCTC
TGCCAAGTATCGCTGGTTCGCCGTCTTCTACCTGATCATCTTCTTCCTGATCCCGCTGACGGTGTTTGGCC
TCTCGCTGGCCGGCTGGCGGGTGCTGGTTGGTGTCGGGGTTCCCGTCGTCTTCATCATCATCCTGGTACTGTGC
CTCCGACTCCTGCAGTCTCGCTGCCCACGCGTCCTGCCGAAGAAACTCCAGAACTGGAACTTCCTGCCGCTGTG
GATGCGCTCGCTGAAGCCCTGGGATGCCGTCGTCTCCAAGTTCACCGGCTGCTTCCAGATGCGCTGCTGCTACT
GCTGCCGCGTGTGCTGCCGCGCGTGCTGCTTGCTGTGTGGCTGCCCCAAGTGCTGCCGCTGCAGCAAGTGCTGC
GAGGACTTGGAGGAGGCGCAGGAGGGGCAGGATGTCCCTGTCAAGGCTCCTGAGACCTTTGATAACATAACCAT
TAGCAGAGAGGCTCAGGGTGAGGTCCCTGCCTCGGACTCAAAGACCGAATGCACGGCCTTGTAGGGGACGCCCC
AGATTGTCAGGGATGGGGGATGGTCCTTGAGTTTTGCATGCTCTCCTCCCTCCCACTTCTGCACCCTTTCACC
ACCTCGAGGAGATTTGCTCCCCATTAGCGAATGAAATTGATGCAGTCCTAAAAAAAAAAA
```

FIGURE 29

```
CAGCCCAGCACCTGCGGAGGGAGCGCTGACCATGGCTCCCTGGCCTGAATTGGGAGATGCCCAGCCCAACCCCG
ATAAGTACCTCGAAGGGGCCGCAGGTCAGCAGCCCACTGCCCCTGATAAAAGCAAAGAGACCAACAAAACAGAT
AACACTGAGGCACCTGTAACCAAGATTGAACTTCTGCCGTCCTACTCCACGGCTACACTGATAGATGAGCCCAC
TGAGGTGGATGACCCCTGGAACCTACCCACTCTTCAGGACTCGGGGATCAAGTGGTCAGAGAGAGACACCAAAG
GGAAGATTCTCTGTTTCTTCCAAGGGATTGGGAGATTGATTTTACTTCTCGGATTTCTCTACTTTTTCGTGTGC
TCCCTGGATATTCTTAGTAGCGCCTTCCAGCTGGTTGGAGGAAAAATGGCAGGACAGTTCTTCAGCAACAGCTC
TATTATGTCCAACCCTTTGTTGGGGCTGGTGATCGGGGTGCTGGTGACCGTCTTGGTGCAGAGCTCCAGCACCT
CAACGTCCATCGTTGTCAGCATGGTGTCCTCTTCATTGCTCACTGTTCGGGCTGCCATCCCCATTATCATGGGG
GCCAACATTGGAACGTCAATCACCAACACTATTGTTGCGCTCATGCAGGTGGGAGATCGGAGTGAGTTCAGAAG
AGCTTTTGCAGGAGCCACTGTCCATGACTTCTTCAACTGGCTGTCCGTGTTGGTGCTCTTGCCCGTGGAGGTGG
CCACCCATTACCTCGAGATCATAACCCAGCTTATAGTGGAGAGCTTCCACTTCAAGAATGGAGAAGATGCCCCA
GATCTTCTGAAAGTCATCACTAAGCCCTTCACAAAGCTCATTGTCCAGCTGGATAAAAAGTTATCAGCCAAAT
TGCAATGAACGATGAAAAAGCGAAAAACAAGAGTCTTGTCAAGATTTGGTGCAAAACTTTTACCAACAAGACCC
AGATTAACGTCACTGTTCCCTCGACTGCTAACTGCACCTCCCCTTCCCTCTGTTGGACGGATGGCATCCAAAAC
TGGACCATGAAGAATGTGACCTACAAGGAGAACATCGCCAAATGCCAGCATATCTTTGTGAATTTCCACCTCCC
GGATCTTGCTGTGGGCACCATCTTGCTCATACTCTCCCTGCTGGTCCTCTGTGGTTGCCTGATCATGATTGTCA
AGATCCTGGGCTCTGTGCTCAAGGGGCAGGTCGCCACTGTCATCAAGAAGACCATCAACACTGATTTCCCCTTT
CCCTTTGCATGGTTGACTGGCTACCTGGCCATCCTCGTCGGGGCAGGCATGACCTTCATCGTACAGAGCAGCTC
TGTGTTCACGTCGGCCTTGACCCCCCTGATTGGAATCGGCGTGATAACCATTGAGAGGGCTTATCCACTCACGC
TGGGCTCCAACATCGGCACCACCACCACCGCCATCCTGGCCGCCTTAGCCAGCCCTGGCAATGCATTGAGGAGT
TCACTCCAGATCGCCCTGTGCCACTTTTTCTTCAACATCTCCGGCATCTTGCTGTGGTACCCGATCCCGTTCAC
TCGCCTGCCCATCCGCATGGCCAAGGGGCTGGGCAACATCTCTGCCAAGTATCGCTGGTTCGCCGTCTTCTACC
TGATCATCTTCTTCTTCCTGATCCCGCTGACGGTGTTTGGCCTCTCGCTGGCCGGCTGGCGGGTGCTGGTTGGT
GTCGGGGTTCCCGTCGTCTTCATCATCATCCTGGTACTGTGCCTCCGACTCCTGCAGTCTCGCTGCCCACGCGT
CCTGCCGAAGAAACTCCAGAACTGGAACTTCCTGCCGCTGTGGATGCGCTCGCTGAAGCCCTGGGATGCCGTCG
TCTCCAAGTTCACCGGCTGCTTCCAGATGCGCTGCTGCTGCTGCTGCCGCGTGTGCTGCCGCGCGTGCTGCTTG
CTGTGTGGCTGCCCCAAGTGCTGCCGCTGCAGCAAGTGCTGCGAGGACTTGGAGGAGGCGCAGGAGGGGCAGGA
TGTCCCTGTCAAGGCTCCTGAGACCTTTGATAACATAACCATTAGCAGAGAGGCTCAGGGTGAGGTCCCTGCCT
CGGACTCAAAGACCGAATGCACGGCCTTGTAGGGGACGCCCCAGATTGTCAGGGATGGGGGATGGTCCTTGAG
TTTTGCATGCTCTCCTCCCTCCCACTTCTGCACCCTTTCACCACCTCGAGGAGATTGCTCCCCATTAGCGAAT
GAAATTGATGCAGTCCTACCTAACTCGATTCCCTTTGGCTTGGTGGGTAGGCCTGCAGGGCACTTTTATTCCAA
CCCATGGCCTCCATGACTTTTTCAAAAAAAAAAAAAAAAAAAAAAAAAAAAAAAAAAAAAAAAAAAAAAAAAAA
```

FIGURE 30

GGCGTGGGAGCTGCCTAGGCCGGGCCCTGCCAGGGAGCAAGTCTGCATCGCAGAGGCCAGGGCAGAGTGGCTCC
TCACAGCCTGAAGCTCATCCTTCTGCACGGGCCAGCCAGGCCAGCACAGAGGCACCAGGGCAGCAGTGCACACA
GGTCCCCGGGGACCCCACCATGTGGAGCGGATGGTGGCTGTGGCCCCTTGTGGCCGTCTGCACTGCAGACTTCT
TTCGGGACGAGGCAGAGAGGATCATGAGGGACTCCCCTGTCATTGATGGGCACAATGACCTCCCCTGGCAGCTG
CTGGATATGTTCAACAACCGGCTGCAGGACGAGAGGGCCAACCTGACCACCTTGGCCGGCACACACACCAACAT
CCCCAAGCTGAGGGCCGGCTTTGTGGGAGGCCAGTTCTGGTCCGTGTACACGCCCTGCGACACCCAGAACAAAG
ACGCCGTGCGGAGGACGCTGGAGCAGATGGACGTGGTCCACCGCATGTGCCGGATGTACCCGGAGACCTTCCTG
TATGTCACCAGCAGTGCAGGCATTCGGCAGGCCTTCCGGGAAGGGAAGGTGGCCAGCCTGATCGGCGTGGAGGG
CGGCCACTCCATTGACAGCAGTTTGGGCGTCCTGCGGGCACTCTATCAGCTGGGCATGCGGTACCTGACCCTCA
CCCACAGCTGCAACACGCCCTGGGCTGACAACTGGCTGGTGGACACGGGAGACAGCGAGCCCCAGAGCCAAGGC
TTGTCACCCTTTGGGCAGCGTGTGGTGAAGGAGCTGAACCGTCTGGGGGTCCTCATCGACTTGGCTCACGTGTC
TGTGGCCACCATGAAGGCCACCCTGCAGCTGTCCAGAGCCCCGGTCATCTTCAGCCACTCCTCGGCCTACAGCG
TGTGCGCAAGCCGGCGCAACGTGCCTGACGACGTCCTGAGGCTGGTGAAACAGACAGACAGCCTGGTGATGGTG
AACTTCTACAACAATTACATTTCCTGCACCAACAAGGCCAACCTGTCCCAAGTGGCCGACCATCTGGATCACAT
CAAGGAGGTGGCAGGAGCCAGAGCCGTGGGTTTTGGTGGGACTTTGATGGTGTTCCAAGGGTCCCTGAGGGGC
TGGAGGACGTCTCCAAGTATCCAGACCTGATCGCTGAGCTGCTCAGGAGGAACTGGACGGAGGCGGAGGTCAAG
GGCGCACTGGCTGACAACCTGCTGAGGGTCTTCCAGGCTGTGGAACAGGCCAGCAACCTCACACAGGCTCCCGA
GGAGGAGCCCATCCCGCTGGACCAGCTGGGTGGCTCCTGCAGGACCCATTACGGCTACTCCTCTGGGGCTTCCA
GCCTCCATCGCCACTGGGGGCTCCTGCTGGCCTCCCTCGCTCCCCTGGTCCTCTGTCTGTCTCTCCTTGAAAC
CTGGGAGACCAGAGTCCCCTTTAGGGTTCCCGGAGCTCCGGGAAGACCCGCCCATCCCAGGACTCCAGATGCCA
GGAGCCCTGCTGCCCACATGCAAGGACCAGCATCTCCTGAGAGGACGCCTGGGCTTACCTGGGGGGCAGGATGC
CTGGGGACAGTTCAGGACACACACACAGTAGGCCCGCAATAAAAGCAACACCCCTTCAAAAAAAAAAAAAAAAA
AAAAA

FIGURE 31

CATCTAAAGCCTCCTCAGCCTTCTGAGTCAGCCTGAAAGGAACAGGCCGAACTGCTGTATGGGCTCTACTGCCA
GTGTGACCTCACCCTCTCCAGTCACCCCTCCTCAGTTCCAGCTATGAGTTCCTGCAACTTCACACATGCCACCT
TTGTGCTTATTGGTATCCCAGGATTAGAGAAAGCCCATTTCTGGGTTGGCTTCCCCCTCCTTTCCATGTATGTA
GTGGCAATGTTTGGAAACTGCATCGTGGTCTTCATCGTAAGGACGGAACGCAGCCTGCACGCTCCGATGTACCT
CTTTCTCTGCATGCTTGCAGCCATTGACCTGGCCTTATCCACATCCACCATGCCTAAGATCCTTGCCCTTTTCT
GGTTTGATTCCCGAGAGATTAGCTTTGAGGCCTGTCTTACCCAGATGTTCTTTATTCATGCCCTCTCAGCCATT
GAATCCACCATCCTGCTGGCCATGGCCTTTGACCGTTATGTGGCCATCTGCCACCCACTGCGCCATGCTGCAGT
GCTCAACAATACAGTAACAGCCCAGATTGGCATCGTGGCTGTGGTCCGCGGATCCCTCTTTTTTTTCCCACTGC
CTCTGCTGATCAAGCGGCTGGCCTTCTGCCACTCCAATGTCCTCTCGCACTCCTATTGTGTCCACCAGGATGTA
ATGAAGTTGGCCTATGCAGACACTTTGCCCAATGTGGTATATGGTCTTACTGCCATTCTGCTGGTCATGGGCGT
GGACGTAATGTTCATCTCCTTGTCCTATTTTCTGATAATACGAACGGTTCTGCAACTGCCTTCCAAGTCAGAGC
GGGCCAAGGCCTTTGGAACCTGTGTGTCACACATTGGTGTGGTACTCGCCTTCTATGTGCCACTTATTGGCCTC
TCAGTTGTACACCGCTTTGGAAACAGCCTTCATCCCATTGTGCGTGTTGTCATGGGTGACATCTACCTGCTGCT
GCCTCCTGTCATCAATCCCATCATCTATGGTGCCAAAACCAAACAGATCAGAACACGGGTGCTGGCTATGTTCA
AGATCAGCTGTGACAAGGACTTGCAGGCTGTGGGAGGCAAGTGACCCTTAACACTACACTTCTCCTTATCTTTA
TTGGCTTGATAAACATAATTATTTCTAACACTAGCTTATTTCCAGTTGCCCATAAGCACATCAGTACTTTTCTC
TGGCTGGAATAGTAAACTAAAGTATGGTACATCTACCTAAAGGACTATTATGTGGAATAATACATACTAATGAA
GTATTACATGATTTAAAGACTACAATAAAACCAAACATGCTTATAACATTAAGAAAAACAATAAAGATACATGA
TTGAAACCAAGTTGAAAAATAGCATATGCCTTGGAGGAAATGTGCTCAAATTACTAATGATTTAGTGTTGTCCC
TACTTTCTCTCTCTTTTTTCTTTCTTTTTTTTTATTATGGTTAGCTGTCACATACAACTTTTTTTTTTTTTGA
GATGGGGTCTCCAGCCTGGGCAACAGAGCAAGACCCTGTCTCAAAGCATAAAATGGAATAACATATCAAATGAA
ACAGGGAAAATGAAGCTGACAATTTATGGGAGCCA

FIGURE 32A

CACACATACGCACGCACGATCTCACTTCGATCTATACACTGGAGGATTAAAACAAACAAACAAAAAAAACATTT
CCTTCGCTCCCCCTCCCTCTCCACTCTGAGAAGCAGAGGAGCCGCACGGCGAGGGGCCGCAGACCGTCTGGA<u>AA</u>
<u>TG</u>CGAATCCTAAAGCGTTTCCTCGCTTGCATTCAGCTCCTCTGTGTTTGCCGCCTGGATTGGGCTAATGGATAC
TACAGACAACAGAGAAAACTTGTTGAAGAGATTGGCTGGTCCTATACAGGAGCACTGAATCAAAAAAATTGGGG
AAAGAAATATCCAACATGTAATAGCCCAAAACAATCTCCTATCAATATTGATGAAGATCTTACACAAGTAAATG
TGAATCTTAAGAAACTTAAATTTCAGGGTTGGGATAAAACATCATTGGAAAACACATTCATTCATAACACTGGG
AAAACAGTGGAAATTAATCTCACTAATGACTACCGTGTCAGCGGAGGAGTTTCAGAAATGGTGTTTAAAGCAAG
CAAGATAACTTTTCACTGGGGAAAATGCAATATGTCATCTGATGGATCAGAGCATAGTTTAGAAGGACAAAAAT
TTCCACTTGAGATGCAAATCTACTGCTTTGATGCGGACCGATTTTCAAGTTTTGAGGAAGCAGTCAAAGGAAAA
GGGAAGTTAAGAGCTTTATCCATTTTGTTTGAGGTTGGGACAGAAGAAAATTTGGATTTCAAAGCGATTATTGA
TGGAGTCGAAAGTGTTAGTCGTTTTGGGAAGCAGGCTGCTTTAGATCCATTCATACTGTTGAACCTTCTGCCAA
ACTCAACTGACAAGTATTACATTTACAATGGCTCATTGACATCTCCTCCCTGCACAGACACAGTTGACTGGATT
GTTTTTAAAGATACAGTTAGCATCTCTGAAAGCCAGTTGGCTGTTTTTTGTGAAGTTCTTACAATGCAACAATC
TGGTTATGTCTGATGGACTACTTACAAAACAATTTTCGAGAGCAACAGTACAAGTTCTCTAGACAGGTGT
TTTCCTCATACACTGGAAAGGAAGAGATTCATGAAGCAGTTTGTAGTTCAGAACCAGAAAATGTTCAGGCTGAC
CCAGAGAATTATACCAGCCTTCTTGTTACATGGGAAAGACCTCGAGTCGTTTATGATACCATGATTGAGAAGTT
TGCAGTTTTGTACCAGCAGTTGGATGGAGAGGACCAAACCAAGCATGAATTTTTGACAGATGGCTATCAAGACT
TGGGTGCTATTCTCAATAATTTGCTACCCAATATGAGTTATGTTCTTCAGATAGTAGCCATATGCACTAATGGC
TTATATGGAAAATACAGCGACCAACTGATTGTCGACATGCCTACTGATAATCCTGAACTTGATCTTTTCCCTGA
ATTAATTGGAACTGAAGAAATAATCAAGGAGGAGGAAGAGGGAAAAGACATTGAAGAAGGCGCTATTGTAATC
CTGGTAGAGACAGTGCTACAAACCAAATCAGGAAAAAGGAACCCCAGATTTCTACCACAACACACTACAATCGC
ATAGGGACGAAATACAATGAAGCCAAGACTAACCGATCCCCAACAAGAGGAAGTGAATTCTCTGGAAAGGGTGA
TGTTCCCAATACATCTTTAAATTCCACTTCCCAACCAGTCACTAAATTAGCCACAGAAAAAGATATTTCCTTGA
CTTCTCAGACTGTGACTGAACTGCCACCTCACACTGTGGAAGGTACTTCAGCCTCTTTAAATGATGGCTCTAAA
ACTGTTCTTAGATCTCCACATATGAACTTGTCGGGGACTGCAGAATCCTTAAATACAGTTTCTATAACAGAATA
TGAGGAGGAGAGTTTATTGACCAGTTTCAAGCTTGATACTGGAGCTGAAGATTCTTCAGGCTCCAGTCCCGCAA
CTTCTGCTATCCCATTCATCTCTGAGAACATATCCCAAGGGTATATATTTTCCTCCGAAAACCCAGAGACAATA
ACATATGATGTCCTTATACCAGAATCTGCTAGAAATGCTTCCGAAGATTCAACTTCATCAGGTTCAGAAGAATC
ACTAAAGGATCCTTCTATGGAGGGAAATGTGTGGTTTCCTAGCTCTACAGACATAACAGCACAGCCCGATGTTG
GATCAGGCAGAGAGAGCTTTCTCCAGACTAATTACACTGAGATACGTGTTGATGAATCGAGAAGACAACCAAG
TCCTTTTCTGCAGGCCCAGTGATGTCACAGGGTCCCTCAGTTACAGATCTGGAAATGCCACATTATTCTACCTT
TGCCTACTTCCCAACTGAGGTAACACCTCATGCTTTTACCCCATCCTCCAGACAACAGGATTTGGTCTCCACGG
TCAACGTGGTATACTCGCAGACAACCCAACCGGTATACAATGGTGAGACACCTCTTCAACCTTCCTACAGTAGT
GAAGTCTTTCCTCTAGTCACCCCTTTGTTGCTTGACAATCAGATCCTCAACACTACCCCTGCTGCTTCAAGTAG
TGATTCGGCCTTGCATGCTACGCCTGTATTTCCCAGTGTCGATGTGTCATTTGAATCCATCCTGTCTTCCTATG
ATGGTGCACCTTTGCTTCCATTTTCCTCTGCTTCCTTCAGTAGTGAATTGTTTCGCCATCTGCATACAGTTTCT
CAAATCCTTCCACAAGTTACTTCAGCTACCGAGAGTGATAAGGTGCCCTTGCATGCTTCTCTGCCAGTGGCTGG
GGGTGATTTGCTATTAGAGCCCAGCCTTGCTCAGTATTCTGATGTGCTGTCCACTACTCATGCTGCTTCAGAGA
CGCTGGAATTTGGTAGTGAATCTGGTGTTCTTTATAAAACGCTTATGTTTTCTCAAGTTGAACCACCCAGCAGT
GATGCCATGATGCATGCACGTTCTTCAGGGCCTGAACCTTCTTATGCCTTGTCTGATAATGAGGGCTCCCAACA
CATCTTCACTGTTTCTTACAGTTCTGCAATACCTGTGCATGATTCTGTGGGTGTAACTTATCAGGGTTCCTTAT
TTAGCGGCCCTAGCCATATACCAATACCTAAGTCTTCGTTAATAACCCCAACTGCATCATTACTGCAGCCTACT
CATGCCCTCTCTGGTGATGGGGAATGGTCTGGAGCCTCTTCTGATAGTGAATTTCTTTTACCTGACACAGATGG
GCTGACAGCCCTTAACATTTCTTCACCTGTTTCTGTAGCTGAATTTACATATACAACATCTGTGTTTGGTGATG
ATAATAAGGCGCTTTCTAAAAGTGAAATAATATATGGAAATGAGACTGAACTGCAAATTCCTTCTTTCAATGAG
ATGGTTTACCCTTCTGAAAGCACAGTCATGCCCAACATGTATGATAATGTAAATAAGTTGAATGCGTCTTTACA
AGAAACCTCTGTTTCCATTTCTAGCACCAAGGGCATGTTTCCAGGGTCCCTTGCTCATACCACCACTAAGGTTT
TTGATCATGAGATTAGTCAAGTTCCAGAAAATAACTTTTCAGTTCAACCTACACATACTGTCTCTCAAGCATCT
GGTGACACTTCGCTTAAACCTGTGCTTAGTGCAAACTCAGAGCCAGCATCCTCTGACCCTGCTTCTAGTGAAAT
GTTATCTCCTTCAACTCAGCTCTTATTTTATGAGACCTCAGCTTCTTTTAGTACTGAAGTATTGCTACAACCTT
CCTTTCAGGCTTCTGATGTTGACACCTTGCTTAAAACTGTTCTTCCAGCTGTGCCCAGTGATCCAATATTGGTT
GAAACCCCCAAAGTTGATAAAATTAGTTCTACAATGTTGCATCTCATTGTATCAAATTCTGCTTCAAGTGAAAA
CATGCTGCACTCTACATCTGTACCAGTTTTTGATGTGTCGCCTACTTCTCATATGCACTCTGCTTCACTTCAAG
GTTTGACCATTTCCTATGCAAGTGAGAAATATGAACCAGTTTTGTTAAAAAGTGAAAGTTCCCACCAAGTGGTA
CCTTCTTTGTACAGTAATGATGAGTTGTTCCAAACGGCCAATTTGGAGATTAACCAGGCCCATCCCCCAAAGG
AAGGCATGTATTTGCTACACCTGTTTTATCAATTGATGAACCATTAAATACACTAATAAATAAGCTTATACATT
CCGATGAAATTTTAACCTCCACCAAAAGTTCTGTTACTGGTAAGGTATTTGCTGGTATTCCAACAGTTGCTTCT
GATACATTTGTATCTACTGATCATTCTGTTCCTATAGGAAATGGGCATGTTGCCATTACAGCTGTTTCTCCCCA
CAGAGATGGTTCTGTAACCTCAACAAAGTTGCTGTTTCCTTCTAAGGCAACTTCTGAGCTGAGTCATAGTGCCA
AATCTGATGCCGGTTTAGTGGGTGGTGGTGAAGATGGTGACACTGATGATGATGGTG<u>A</u>TGATGATGATGACAGA
GATAGTGATGGCTTATCCATTCATAAGTGTATGTCATGCTCATCCTATAGAGAATCACAGGAAAAGGTAATGAA

FIGURE 32B

```
TGATTCAGACACCCACGAAAACAGTCTTATGGATCAGAATAATCCAATCTCATACTCACTATCTGAGAATTCTG
AAGAAGATAATAGAGTCACAAGTGTATCCTCAGACAGTCAAACTGGTATGGACAGAAGTCCTGGTAAATCACCA
TCAGCAAATGGGCTATCCCAAAAGCACAATGATGGAAAAGAGGAAAATGACATTCAGACTGGTAGTGCTCTGCT
TCCTCTCAGCCCTGAATCTAAAGCATGGGCAGTTCTGACAAGTGATGAAGAAAGTGGATCAGGGCAAGGTACCT
CAGATAGCCTTAATGAGAATGAGACTTCCACAGATTTCAGTTTTGCAGACACTAATGAAAAAGATGCTGATGGG
ATCCTGGCAGCAGGTGACTCAGAAATAACTCCTGGATTCCCACAGTCCCCAACATCATCTGTTACTAGCGAGAA
CTCAGAAGTGTTCCACGTTTCAGAGGCAGAGGCCAGTAATAGTAGCCATGAGTCTCGTATTGGTCTAGCTGAGG
GGTTGGAATCCGAGAAGAAGGCAGTTATACCCCTTGTGATCGTGTCAGCCCTGACTTTTATCTGTCTAGTGGTT
CTTGTGGGTATTCTCATCTACTGGAGGAAATGCTTCCAGACTGCACACTTTTACTTAGAGGACAGTACATCCCC
TAGAGTTATATCCACACCTCCAACACCTATCTTTCCAATTTCAGATGATGTCGGAGCAATTCCAATAAAGCACT
TTCCAAAGCATGTTGCAGATTTACATGCAAGTAGTGGGTTTACTGAAGAATTTGAGACACTGAAAGAGTTTTAC
CAGGAAGTGCAGAGCTGTACTGTTGACTTAGGTATTACAGCAGACAGCTCCAACCACCCAGACAACAAGCACAA
GAATCGATACATAAATATCGTTGCCTATGATCATAGCAGGGTTAAGCTAGCACAGCTTGCTGAAAAGGATGGCA
AACTGACTGATTATATCAATGCCAATTATGTTGATGGCTACAACAGACCAAAAGCTTATATTGCTGCCCAAGGC
CCACTGAAATCCACAGCTGAAGATTTCTGGAGAATGATATGGGAACATAATGTGGAAGTTATTGTCATGATAAC
AAACCTCGTGGAGAAAGGAAGGAGAAAATGTGATCAGTACTGGCCTGCCGATGGGAGTGAGGAGTACGGGAACT
TTCTGGTCACTCAGAAGAGTGTGCAAGTGCTTGCCTATTATACTGTGAGGAATTTTACTCTAAGAAACACAAAA
ATAAAAAAGGGCTCCCAGAAAGGAAGACCCAGTGGACGTGTGGTCACACAGTATCACTACACGCAGTGGCCTGA
CATGGGAGTACCAGAGTACTCCCTGCCAGTGCTGACCTTTGTGAGAAAGGCAGCCTATGCCAAGCGCCATGCAG
TGGGGCCTGTTGTCGTCCACTGCAGTGCTGGAGTTGGAAGAACAGGCACATATATTGTGCTAGACAGTATGTTG
CAGCAGATTCAACACGAAGGAACTGTCAACATATTTGGCTTCTTAAAACACATCCGTTCACAAAGAAATTATTT
GGTACAAACTGAGGAGCAATATGTCTTCATTCATGATACACTGGTTGAGGCCATACTTAGTAAAGAAACTGAGG
TGCTGGACAGTCATATTCATGCCTATGTTAATGCACTCCTCATTCCTGGACCAGCAGGCAAAACAAAGCTAGAG
AAACAATTCCAGCTCCTGAGCCAGTCAAATATACAGCAGAGTGACTATTCTGCAGCCCTAAAGCAATGCAACAG
GGAAAAGAATCGAACTTCTTCTATCATCCCTGTGGAAAGATCAAGGGTTGGCATTTCATCCCTGAGTGGAGAAG
GCACAGACTACATCAATGCCTCCTATATCATGGGCTATTACCAGAGCAATGAATTCATCATTACCCAGCACCCT
CTCCTTCATACCATCAAGGATTTCTGGAGGATGATATGGGACCATAATGCCCAACTGGTGGTTATGATTCCTGA
TGGCCAAAACATGGCAGAAGATGAATTTGTTTACTGGCCAAATAAAGATGAGCCTATAAATTGTGAGAGCTTTA
AGGTCACTCTTATGGCTGAAGAACACAAATGTCTATCTAATGAGGAAAAACTTATAATTCAGGACTTTATCTTA
GAAGCTACACAGGATGATTATGTACTTGAAGTGAGGCACTTTCAGTGTCCTAAATGGCCAAATCCAGATAGCCC
CATTAGTAAAACTTTTGAACTTATAAGTGTTATAAAAGAAGAAGCTGCCAATAGGGATGGGCCTATGATTGTTC
ATGATGAGCATGGAGGAGTGACGGCAGGAACTTTCTGTGCTCTGACAACCCTTATGCACCAACTAGAAAAAGAA
AATTCCGTGGATGTTTACCAGGTAGCCAAGATGATCAATCTGATGAGGCCAGGAGTCTTTGCTGACATTGAGCA
GTATCAGTTTCTCTACAAAGTGATCCTCAGCCTTGTGAGCACAAGGCAGGAAGAGAATCCATCCACCTCTCTGG
ACAGTAATGGTGCAGCATTGCCTGATGGAAATATAGCTGAGAGCTTAGAGTCTTTAGTTTAACACAGAAAGGGG
TGGGGGGACTCACATCTGAGCATTGTTTTCCTCTTCCTAAAATTAGGCAGGAAAATCAGTCTAGTTCTGTTATC
TGTTGATTTCCCATCACCTGACAGTACTTTCATGACATAGGATTCTGCCGCCAAATTTATATCATTAACAATG
TGTGCCTTTTTGCAAGACTTGTAATTTACTTATTATGTTTGAACTAAAATGATTGAATTTTACAGTATTTCTAA
GAATGGAATTGTGGTATTTTTTTCTGTATTGATTTTAACAGAAAATTTCAATTTATAGAGGTTAGGAATTCCAA
ACTACAGAAATGTTTGTTTTTAGTGTCAAATTTTTAGCTGTATTTGTAGCAATTATCAGGTTTGCTAGAAATA
TAACTTTTAATACAGTAGCCTGTAAATAAAACACTCTTCCATATGATATTCAACATTTTACAACTGCAGTATTC
ACCTAAAGTAGAAATAATCTGTTACTTATTGTAAATACTGCCCTAGTGTCTCCATGGACCAAATTTATATTTAT
AATTGTAGATTTTTATATTTTACTACTGAGTCAAGTTTTCTAGTTCTGTGTAATTGTTTAGTTTAATGACGTAG
TTCATTAGCTGGTCTTACTCTACCAGTTTTCTGACATTGTATTGTGTTACCTAAGTCATTAACTTTGTTTCAGC
ATGTAATTTTAACTTTTGTGGAAAATAGAAATACCTTCATTTTGAAAGAAGTTTTTATGAGAATAACACCTTAC
CAAACATTGTTCAAATGGTTTTTATCCAAGGAATTGCAAAATAAATATAAATATTGCCATTAAAAAAAAAAAA
AAAAAAAAAAAAAAAAAAAAAA
```

FIGURE 33

ATTGTCTGGGAATTGCAGCCGCGGGGCGGGCGGCGGCGGCGGCGGCGGCCGGGACCCAGCGGGCCAGGTGG
GGACGGCGCGGAGCGGGTGCGGGAGATGCCGTGCGGGACTGGGGCCACCTGAGCCGCCCGCCTCGTCCCGCCT
TCTGTGGGAAGGATGTGCGCGCGGATGGCCGGTCGCACAAGAGCGGCCCCTCGGGGGCCCTACGGCCCCTGGCT
CTGCCTCCTGGTGGCCCTCGCCCTGGACGTCGTGAGAGTGGACTGTGGCCAGGCTCCCCTGGACCCTGTCTACC
TGCATGTGACAGCCGCCCGCCCAGCCCAGCCCACACTCTGGACTGCCAAGCTAGACCGCTTCAAGGGCTCCAGG
CACCACACCACCCTCATCACCTGCCACCGTGCTGGGCTCACAGAGCCAGATTCCAGCAGTCCCCTTGAACTGTC
TGAGTTCCTATGGGTGGACTTTGTGGTGGAGAATAGCACTGGTGGGGCGTAGCGGTCACTCGCCCCGTCACGT
GGCAGCTGGAGTACCCAGGCCAGGCCCCTGAAGCAGAGAAGGACAAAATGGTGTGGGAAATCCTGGTGTCTGAG
CGGGACATCAGAGCCCTTATCCCACTGGCCAAGGCTGAGGAGCTGGTGAATACAGCACCACTGACTGGAGTGCC
CCAGCATGTCCCCGTGCGCCTTGTCACTGTGGACGGCGGGGGGCCTTGGTGGAGGTGACAGAGCATGTCGGCT
GCGAGTCTGCCAACACACAGGTCCTGCAGGTGTCTGAGGCCTGTGATGCCGTGTTCGTGGCTGGCAAGGAGAGC
CGGGGCGCCCGGGGGGTGCGAGTGGACTTCTGGTGGCGCCGGCTCCGCGCCTCGCTGCGGCTGACCGTGTGGGC
CCCGCTGCTACCGCTGCGTATCGAGCTCACCGACACCACCCTCGAGCAGGTCCGCGGCTGGAGGGTACCTGGCC
CTGCTGAAGGGCCTGCGGAACCCGCTGCAGAGGCGTCAGATGAGGCCGAGCGGCGCGCCCGTGGCTGCCACCTG
CAGTACCAGCGGGCCGGTGTGCGCTTCCTCGCCCCCTTCGCGGCCCACCCGCTGGACGGCGGCCGCCGCCTCAC
GCACCTGCTTGGCCCCGACTGGCTGCTAGACGTGTCCCACCTCGTGGCGCCACACGCCCGCGTGCTGGACTCGC
GTGTAGCCTCTCTGGAGGGTGGCCGTGTCGTGGTGGGCCGGGAGCCCGGTGTCACCTCCATTGAGGTGCGTTCC
CCACTGTCTGACTCCATCCTGGGGGAGCAGGCGCTGGCTGTGACGGACGACAAGGTCTCAGTGCTGGAGCTGAG
GGTGCAGCCAGTGATGGGCATCTCGCTGACCTTGAGCCGGGGCACTGCCCACCCCGGGGAGGTCACAGCTACGT
GCTGGGCACAGTCAGCCCTTCCCGCCCCAAAGCAGGAGGTGGCCCTCTCCCTATGGCTGTCCTTCTCTGATCAC
ACTGTGGCCCCAGCTGAGCTCTACGACCGCCGTGACCTGGGACTGTCCGTCTCAGCCGAGGAGCCTGGTGCCAT
CCTGCCAGCTGAGGAGCAGGGTGCCCAGCTCGGGGTGGTGGTGAGTGGGGCAGGCGCCGAGGGGCTGCCGCTGC
ATGTGGCTCTGCACCCGCCCGAGCCCTGCCGCCGGGGCCGCCACCGTGTGCCTCTGGCCTCTGGCACCGCCTGG
CTGGGGCTGCCCCCTGCCTCCACTCCAGCCCCTGCTCTCCCATCCAGCCCTGCTTGGAGCCCACCAGCCACAGA
AGCCACCATGGGTGGTAAACGGCAGGTGGCAGGCAGTGTCGGGGGCAACACAGGTGTGAGGGGCAAGTTTGAGC
GGGCAGAGGAGGAGGCCAGGAAGGAGGAGACCGAAGCCAGGGAGGAGGAGGAGGAAGAGGAGGAGGAGATGGTC
CCTGCCCCTCAGCATGTCACTGAGCTAGAGCTGGGCATGTACGCCCTGCTGGGAGTCTTCTGCGTGGCCATCTT
CATCTTCTTGGTCAATGGTGTGGTCTTCGTCCTGCGCTATCAGCGCAAAGAACCTCCCGACAGTGCCACTGACC
CCACCTCCCCCCAGCCCCACAACTGGGTCTGGCTGGGCACTGACCAGGAGGAACTGAGCCGCCAGCTGGACCGG
CAGTCCCCTGGCCCGCCCAAGGGGGAGGGGAGCTGCCCCTGTGAGAGTGGGGGAGGAGGGGAGGCCCCTACCCT
GGCCCCTGGCCCTCCTGGGGGCACCACCAGCTCCTCAAGCACCCTGGCCCGAAAGGAGGCTGGGGGGCGGCGGA
AGCGAGTAGAGTTTGTGACATTTGTGCCAGCCCCTCCAGCCCAGTCACCTGAGGAGCCTGTAGGGGCCCCTGCT
GTGCAGTCCATCCTTGTGGCAGGCGAGGAGGACATCCGCTGGGTGTGTGAGGACATGGGCTGAAGGACCCTGA
GGAGCTTCGCAACTACATGGAGAGGATCCGGGGCAGCTCCTGACCCTCCACAGCCACCTGGTCAGCCACCAGCT
GGGGCAACGAGGGTGGAGGTCCCACTGAGCCTCTCGCCTGCCCCGCCACTCGTCTGGTGCTTGTTGATCCAAG
TCCCCTGCCTGGTCCCCACAAGGACTCCCATCCAGGCCCCTCTGCCCTGCCCCTTGTCATGGACCATGGTCG
TGAGGAAGGGCTCATGCCCCTTATTTATGGGAACCATCTCATTCTAACAGAATAAACCGAGAAGGAAACCAGAA
AAAAAAAAAAAAAAAA

FIGURE 34

ACGCGTCCGCCCACGCGTCCGCCCACGCGTCCGGTCGGGGCCAGAGCGCAGGTGTACCTGGCGGCCGTGCTGGA
GCACCTGACCGCCGAGATCCTGGAGCTGGCTGGCAACCCGGCCCGCGACAAGAAGACCCGCATCATCCTGCGCC
ACCTGTAGCTGGCCATTCGCAACGGCGAGGAGCTTAACAAGCTGCTGGGCGAAGTCACCATCGCGCAGGGCGGT
GTCCTGCCCAACATTCAGGGCGTGCTTCTGCCCCAGAAGACCAAGAGCCACCACAAGGCCAAGGGTGAAAACCA
TTCACTAGGAGAGGAGAAACACAATGGCCACCAAGACAGAGTTGAGTCCCACAGCAAGGGAGAGCAAGAACGCA
CAAGATATGCAAGTGGATGAGACACTGATCCCCAGGAAAGGTCCAAGTTTATGTTCTGCTCGCTATGGAATAGC
CCTCGTCTTACATTTCTGCAATTTCACAACGATAGCACAAAATGTCATCATGAACATCACCATGGTAGCCATGG
TCAACAGCACAAGCCCTCAATCCCAGCTCAATGATTCCTCTGAGGTGCTGCCTGTTGACTCATTTGGTGGCCTA
AGTAAAGCCCCAAAGAGTCTTCCTGCAAAGTCCTCAATACTTGGGGGTCAGTTTGCAATTTGGGAAAAGTGGGG
CCCTCCACAAGAACGAAGCAGACTCTGCAGCATTGCTTTATCAGGAATGTTACTGGGATGCTTTACTGCCATCC
TCATAGGTGGCTTCATTAGTGAAACCCTTGGGTGGCCCTTTGTCTTCTATATCTTTGGAGGTGTTGGCTGTGTC
TGCTGCCTTCTCTGGTTTGTTGTGATTTATGATGACCCCTTTTCCTATCCATGGATAAGCACCTCAGAAAAAGA
ATACATCATATCCTCCTTGAAACAACAGGTCGGGTCTTCTAAGCAGCCTCTTCCCATCAAAGCTATGCTCAGAT
CTCTACCCATTTGGTCCATATGTTTAGGCTGTTTCAGCCATCAATGGTTAGTTAGCACAATGGTTGTATACATA
CCAACTTACATCAGCTCTGTGTACCATGTTAACATCAGAGACAATGGACTTCTATCTGCCCTTCCTTTTATTGT
TGCCTGGGTCATAGGCATGGTGGGAGGCTATCTGGCAGATTTCCTTCTAACCAAAAAGTTTAGACTCATCACTG
TGAGGAAAATTGCCACAATTTTAGGAAGTCTCCCCTCTTCAGCACTCATTGTGTCTCTGCCTTACCTCAATTCC
GGCTATATCACAGCAACTGCCTTGCTGACGCTCTCTTGCGGATTAAGCACATTGTGTCAGTCAGGGATTTATAT
CAATGTCTTAGATATTGCTCCAAGGTATTCCAGTTTTCTCATGGGAGCATCAAGAGGATTTCGAGCATAGCAC
CTGTCATTGTACCCACTGTCAGCGGATTTCTTCTTAGTCAGGACCCTGAGTTTGGGTGGAGGAATGTCTTCTTC
TTGCTGTTTGCCGTTAACCTGTTAGGACTACTCTTCTACCTCATATTTGGAGAAGCAGATGTCCAAGAATGGGC
TAAAGAGAGAAAACTCACTCGTTTATGAAGTTATCCCACCTTGGATGGAAAGTCATTAGGCACCGTATTGCAT
AAAATAGAAGGCTTCCGTGATGAAAATACCAGTGAAAAGATTTTTTTTTCCTGTGGCTCTTTTCAATTATGAGA
TCAGTTCATTATTTTATTCAGACTTTTTTTTGAGAGAAATGTAAGATGAATAAAAATTCAAATAAATGATAAC
TAAGAAAAAAAAAAAAAAA

FIGURE 35

GTGAAAACCATTCACTAGGAGAGGAGAAACACAATGGCCACCAAGACAGAGTTGAGTCCCACAGCAAGGGAGAG
CAAGAACGCACAAGATATGCAAGTGGATGAGACACTGATCCCCAGGAAAGTTCCAAGTTTATGTTCTGCTCGCT
ATGGAATAGCCCTCGTCTTACATTTCTGCAATTTCACAACGATAGCACAAAATGTCATCATGAACATCACCATG
GTAGCCATGGTCAACAGCACAAGCCCTCAATCCCAGCTCAATGATTCCTCTGAGGTGCTGCCTGTTGACTCATT
TGGTGGCCTAAGTAAAGCCCCAAAGAGTCTTCCTACAAAGTCCTCAATACTTGGGGGTCAGTTTGCAATTTGGG
AAAAGTGGGGCCCTCCACAAGAACGAAGCAGACTCTGCAGCATTGCTTTATCAGGAATGTTACTGGGATGCTTT
ACTGCCATCCTCATAGGTGGCTTCATTAGTGAAACCCTTGGGTGGCCCTTTGTCTTCTATATCTTTGGAGGTGT
TGGCTGTGTCTGCTGCCTTCTCTGGTTTGTTGTGATTTATGATGACCCCGTTTCCTATCCATGGATAAGCACCT
CAGAAAAAGAATACATCATATCCTCCTTGAAACAACAGGTCAGGTCTTCTAAGCAGCCTCTTCCCATCAAAGCT
ATGCTCAGATCTCTACCCATTTGGTCCATATGTTAGGCTGTTTCAGCCATCAATGGTTAGTTAGCACAATGGT
TGTATACATACCAACTTACATCAGCTCTGTGTACCATGTTAACATCAGAGACAATGGACTTCTATCTGCCCTTC
CTTTTATTGTTGCCTGGGTCATAGGCATGGTGGGAGGCTATCTGGCAGATTTCCTTCTAACCAAAAAGTTTAGA
CTCATCACTGTGAGGAAAATTGCCACAATTTTAGGAAGTCTCCCCTCTTCAGCACTCATTGTGTCTCTGCCTTA
CCTCAATTCCGGCTATATCACAGCAACTGCCTTGCTGACGCTCTCTTGCGGATTAAGCACATTGTGTCAGTCAG
GGATTTATATCAATGTCTTAGATATTGCTCCAAGGTATTCCAGTTTTCTCATGGGAGCATCAAGAGGATTTTCG
AGCATAGCACCTGTCATTGTACCCACTGTCAGCGGATTTCTTCTTAGTCAGGACCCTGAGTTTGGGTGGAGGAA
TGTCTTCTTCTTGCTGTTTGCCGTTAACCTGTTAGGACTACTCTTCTACCTCATATTTGGAGAAGCAGATGTCC
AAGAATGGGCTAAAGAGAGAAAACTCACTCGTTTATGAAGTTATCCCACCTTGGATGGAAAAGTCATTAGGCAC
CGTATTGCATAAAATAGAAGGCTTCCGTGATGAAAATACCAGTGAAAAGATTTTTTTTCCTGTGGCTCTTTTC
AATTATGAGATCAGTTCATTATTTTATTCAGACTTTTTTTGAGAGAAATGTAAGATGAATAAAAATTCAAATA
AAATGATAACTAAGAAAAAAAAAAAAAAA

FIGURE 36

```
GCTCGCTGGGCCGCTGCTCCCGGGTGTCCCAGGCCCGGCCGGTGCGCAGAGCATGGCGGGTGCGGGCCCGAAGCGGCGCGCG
CTAGCGGCGCCGGCGGCCGAGGAGAAGGAAGAGGCGCGGGAGAAGATGCTGGCCGCCAAGAGCGCGGACGGCTCGGCGCCGG
CAGGCGAGGGCGAGGGCGTGACCCTGCAGCGGAACATCACGCTGCTCAACGGCGTGGCCATCATCGTGGGGACCATTATCGG
CTCGGGCATCTTCGTGACGCCCACGGGCGTGCTCAAGGAGGCAGGCTCGCCGGGGCTGGCGCTGGTGGTGTGGGCCGCGTGC
GGCGTCTTCTCCATCGTGGGCGCGCTCTGCTACGCGGAGCTCGGCACCACCATCTCCAAATCGGGCGGCGACTACGCCTACA
TGCTGGAGGTCTACGGCTCGCTGCCCGCCTTCCTCAAGCTCTGGATCGAGCTGCTCATCATCCGGCCTTCATCGCAGTACAT
CGTGGCCCTGGTCTTCGCCACCTACCTGCTCAAGCCGCTCTTCCCCACCTGCCCGGTGCCCGAGGAGGCAGCCAAGCTCGTG
GCCTGCCTGTGCGTGCTGCTGCTCACGGCCGTGAACTGCTACAGCGTGAAGGCCGCCACCCGGGTCCAGGATGCCTTTGCCG
CCGCCAAGCTCCTGGCCCTGGCCCTGATCATCCTGCTGGGCTTCGTCCAGATCGGAAAGGGTGATGTGTCCAATCTAGATCC
CAAGTTCTCATTTGAAGGCACCAAACTGGATGTGGGGAACATTGTGCTGGCATTATACAGCGGCCTCTTTGCCTATGGAGGA
TGGAATTACTTGAATTTCGTCACAGAGGAAATGATCAACCCCTACAGAAACCTGCCCCTGGCCATCATCATCTCCCTGCCCA
TCGTGACGCTGGTGTACGTGCTGACCAACCTGGCCTACTTCACCACCCTGTCCACCGAGCAGATGCTGTCGTCCAGGCCGT
GGCCGTGGACTTCGGGAACTATCACCTGGGCGTCATGTCCTGGATCATCCCCGTCTTCGTGGGCCTGTCCTGCTTTGGCTCC
GTCAATGGGTCCCTGTTCACATCCTCCAGGCTCTTCTTCGTGGGGTCCCGGGAAGGCCACCTGCCCTCCATCCTCTCCATGA
TCCACCCACAGCTCCTCACCCCCGTGCCGTCCCTCGTGTTCACGTGTGTGATGACGCTGCTCTACGCCTTCTCCAAGGACAT
CTTCTCCGTCATCAACTTCTTCAGCTTCTTCAACTGGCTCTGCGTGGCCCTGGCCATCATCGGCATGATCTGGCTGCGCCAC
AGAAAGCCTGAGCTTGAGCGGCCCATCAAGGTGAACCTGGCCCTGCCTGTGTTCTTCATCCTGGCCTGCCTCTTCCTGATCG
CCGTCTCCTTCTGGAAGACACCCGTGGAGTGTGGCATCGGCTTCACCATCATCCTCAGCGGGCTGCCCGTCTACTTCTTCGG
GGTCTGGTGGAAAAACAAGCCCAAGTGGCTCCTCCAGGGCATCTTCTCCACGACCGTCCTGTGTCAGAAGCTCATGCAGGTG
GTCCCCCAGGAGACATAGCCAGGAGGCCGAGTGGCTGCCGGAGGAGCATGCGCAGAGGCCAGTTAAAGTAGATCACCTCCTC
GAACCCACTCCGGTTCCCCGCAACCCACAGCTCAGCTGCCCATCCCAGTCCTCGCCGTCCCTCCCAGGTCGGGCAGTGGAGG
CTGCTGTGAAAACTCTGGTACGAATCTCATCCCTCAACTGAGGGCCAGGGACCCAGGTGTGCCTGTGCTCCTGCCCAGGAGC
AGCTTTTGGTCTCCTTGGGCCCTTTTTCCCTTCCCTCCTTTGTTTACTTATATATATATTTTTTTAAACTTAAATTTTGGG
TCAACTTGACACCACTAAGATGATTTTTAAGGAGCTGGGGAAGGCAGGAGCCTTCCTTTCTCCTGCCCCAAGGGCCCAGA
CCCTGGGCAAACAGAGCTACTGAGACTTGGAACCTCATTGCTACCACAGACTTGCACTGAAGCCAGACAGCTGCCCAGACAC
ATGGGCTTGTGACATTCGTGAAAACCAACCCTGTGGGCTTATGTCTCTGCCTTAGGGTTTGCAGAGTGGAAACTCAGCCGTA
GGGTGGCACTGGGAGGGGGTGGGGGATCTGGGCAAGGTGGGTGATTCCTCCCAGGAGGTGCTTGAGGCCCCGATGGACTCCT
GACCATAATCCTAGCCCCGAGACACCATCCTGAGCCAGGGAACAGCCCCAGGGTTGGGGGGTGCCGGCATCTCCCCTAGCTC
ACCAGGCCTGGCCTCTGGGCAGTGTGGCCTCTTGGCTATTTCTGTTCCAGTTTTGGAGGCTGAGTTCTGGTTCATGCAGACA
AAGCCCTGTCCTTCAGTCTTCTAGAAACAGAGACAAGAAAGGCAGACACACCGCGGCCAGGCACCCATGTGGGCGCCCACCC
TGGGCTCCACACAGCAGTGTCCCCTGCCCCAGAGGTCGCAGCTACCCTCAGCCTCCAATGCATTGGCCTCTGTACCGCCCGG
CAGCCCCTTCTGGCCGGTGCTGGGTTCCCACTCCCGGCCTAGGCACCTCCCCGCTCTCCCTGTCACGCTCATGTCCTGTCCT
GGTCCTGATGCCCGTTGTCTAGGAGACAGAGCCAAGCACTGCTCACGTCTCTGCCGCCTGCGTTTGGAGGCCCCTGGGCTCT
CACCCAGTCCCCACCCGCCTGCAGAGAGGGAACTAGGGCACCCCTTGTTTCTGTTGTTCCCGTGAATTTTTTTCGCTATGGG
AGGCAGCCGAGGCCTGGCCAATGCGGCCCACTTTCCTGAGCTGTCGCTGCCTCCATGGCAGCAGCCAAGGACCCCCAGAACA
AGAAGACCCCCCCGCAGGATCCCTCCTGAGCTCGGGGGGCTCTGCCTTCTCAGGCCCCGGGCTTCCCTTCTCCCCAGCCAGA
GGTGGAGCCAAGTGGTCCAGCGTCACTCCAGTGCTCAGCTGTGGCTGGAGGAGCTGGCCTGTGGCACAGCCCTGAGTGTCCC
AAGCCGGGAGCCAACGAAGCCGGACACGGCTTCACTGACCAGCGGCTGCTCAAGCCGCAAGCTCTCAGCAAGTGCCCAGTGG
AGCCTGCCGCCCCCACCTGGGCACCGGGACCCCCTCACCATCCAGTGGGCCCGGAGAAACCTGATGAACAGTTTGGGGACTC
AGGACCAGATGTCCGTCTCTCTTGCTTGAGGAATGAAGACCTTTATTCACCCCTGCCCCGTTGCTTCCCGCTGCACATGGAC
AGACTTCACAGCGTCTGCTCATAGGACCTGCATCCTTCCTGGGGACGAATTCCACTCGTCCAAGGGACAGCCCACGGTCTGG
AGGCCGAGGACCACCAGCAGGCAGGTGGACTGACTGTGTTGGGCAAGACCTCTTCCCTCTGGGCCTGTTCTTGGCTGCAA
ATAAGGACAGCAGCTGGTGCCCCACCTGCCTGGTGCATTGCTGTGTGAATCCAGGAGGCAGTGGACATCGTAGGCAGCCACG
GCCCCAGGTCCAGGAGAAGTGCTCCCTGGAGGCACGGACCACTGCTTCCCACTGGGGCCGGCGGGGCCCACGCACGACGTCA
GCCTCTTACCTTCCCGCCTCGGCTAGGGGTCCTCGGGATGCCGTTCTGTTCCAACCTCCTGTTCTGGGAGGTGGACATGCCT
CAAGGATACAGGGAGCCGGCGGCCTCTCGACGGCACGCACTTCCTGTTGGCTGCTGCGGCTGTGGGCGAGCATGGGGGCTGC
CAGCGTCTGTTGTGGAAAGTAGCTGCTAGTGAAATGGCTGGGGCCGCTGGGGTCCGTCTTCACACTGCGCAGGTCTCTTCTG
GGCGTCTGAGCTGGGGTGGGAGCTCCTCCGCAGAAGGTTGGTGGGGGGTCCAGTCTGTGATCCTTGGTGCTGTGTGCCCCAC
TCCAGCCTGGGGACCCCACTTCAGAAGGTAGGGGCCGTGTCCCGCGGTGCTGACTGAGGCCTGCTTCCCCCTCCCCCTCCTG
CTGTGCTGGAATTCCACAGGGACCAGGGCCACCGCAGGGGACTGTCTCAGAAGACTTGATTTTTCCGTCCCTTTTTCTCCAC
ACTCCACTGACAAACGTCCCCAGCGGTTTCCACTTGTGGGCTTCAGGTGTTTTCAAGCACAACCCACCACAACAAGCAAGTG
CATTTTCAGTCGTTGTGCTTTTTTTGTTTTGTGCTAACGTCTTACTAATTTAAAGATGCTGTCGGCACCATGTTTATTTATTT
CCAGTGGTCATGCTCAGCCTTGCTGCTCTGCGTGGCGCAGGTGCCATGCCTGCTCCCTGTCTGTCCCAGCCACGCAGGGC
CATCCACTGTGACGTCGGCCGACCAGGCTGGACACCCTCTGCCGAGTAATGACGTGTGTGGCTGGACCTTCTTTATTCTGT
GTTAATGGCTAACCTGTTACACTGGGCTGGGTTGGGTAGGGTGTTCTGGCTTTTTTGTGGGGTTTTATTTTTAAAGAAACA
CTCAATCATCCTAG
```

FIGURE 37

ATTCGCCCTTTGCTCCCGGGTGTCCCAGGCCCGGCCGGTGCGCAGAGCATGGCGGGTGCGGGCCCGAAGCGGCG
CGCGCTAGCGGCGCCGGCGGCCGAGGAGAAGGAAGAGGCGCGGGAGAAGATGCTGGCCGCCAAGAGCGCGGACG
GCTCGGCGCCGGCAGGCGAGGGCGAGGGCGTGACCCTGCAGCGGAACATCACGCTGCTCAACGGCGTGGCCATC
ATCGTGGGGACCATTATCGGCTCGGGCATCTTCGTGACGCCCACGGGCGTGCTCAAGGAGGCAGGCTCGCCGGG
GCTGGCGCTGGTGGTGTGGGCCGCGTGCGGCGTCTTCTCCATCGTGGGCGCGCTCTGCTACGCGGAGCTCGGCA
CCACCATCTCCAAATCGGGCGGCGACTACGCCTACATGCTGGAGGTCTACGGCTCGCTGCCCGCCTTCCTCAAG
CTCTGGATCGAGCTGCTCATCATCCGGCCTTCATCGCAGTACATCGTGGCCCTGGTCTTCGCCACCTACCTGCT
CAAGCCGCTCTTCCCCACCTGCCCGGTGCCCGAGGAGGCAGCCAAGCTCGTGGCCTGCCTCTGCGTGCTGCTGC
TCACGGCCGTGAACTGCTACAGCGTGAAGGCCGCCACCCGGGTCCAGGATGCCTTTGCCGCCGCCAAGCTCCTG
GCCCTGGCCCTGATCATCCTGCTGGGCTTCGTCCAGATCGGGAAGGGTGATGTGTCCAATCTAGATCCCAACTT
CTCATTTGAAGGCACCAAACTGGATGTGGGGAACATTGTGCTGGCATTATACAGCGGCCTCTTTGCCTATGGAG
GATGGAATTACTTGAATTTCGTCACAGAGGAAATGATCAACCCCTACAGAAACCTGCCCCTGGCCATCATCATC
TCCCTGCCCATCGTGACGCTGGTGTACGTGCTGACCAACCTGGCCTACTTCACCACCCTGTCCACCGAGCAGAT
GCTGTCGTCCGAGGCCGTGGCCGTGGACTTCGGGAACTATCACCTGGGCGTCATGTCCTGGATCATCCCCGTCT
TCGTGGGCCTGTCCTGCTTCGGCTCCGTCAATGGGTCCCTGTTCACATCCTCCAGGCTCTTCTTCGTGGGGTCC
CGGGAAGGCCACCTGCCCTCCATCCTCTCCATGATCCACCCACAGCTCCTCACCCCCGTGCCGTCCCTCGTGTT
CACGTGTGTGATGACGCTGCTCTACGCCTTCTCCAAGGACATCTTCTCCGTCATCAACTTCTTCAGCTTCTTCA
ACTGGCTCTGCGTGGCCCTGGCCATCATCGGCATGATCTGGCTGCGCCACAGAAAGCCTGAGCTTGAGCGGCCC
ATCAAGGTGAACCTGGCCCTGCCTGTGTTCTTCATCCTGGCCTGCCTCTTCCTGATCGCCGTCTCCTTCTGGAA
GACACCCGTGGAGTGTGGCATCGGCTTCACCATCATCCTCAGCGGGCTGCCCGTCTACTTCTTCGGGGTCTGGT
GGAAAAACAAGCCCAAGTGGCTCCTCCAGGGCATCTTCTCCACGACCGTCCTGTGTCAGAAGCTCATGCAGGTG
GTCCCCCAGGAGACATAGCCAGGAGGCCGAAGGGCG

FIGURE 38

```
CCAGGCTCTCCACCCCCACTTCCCAATTGAGGAAACCGAGGCAGAGGAGGCTCAGGTGTGGCCAATCACCCTGC
ACATCAGAGTTACCCTGGGCAGGGCCCACTGAGACCTGGGAGGGGCCACTCGGGACCTGGAGGGCTGGGGGCTG
CCCGGGCGTTAGGGGTAAAGCTCCCTACCCAACTGCGCAGAAGGCCTCAGAGGCCTGGGGGCTGGGCTTCCCCT
TTCACATCGCCCTTTAGAGGCCCACGTGTGGGCATTGGCCCGCGATCTGAAAGGGGCTGTCCTGTTCCTCATGG
GCGCTGCCAGCGCCACGCACTCCTCTTTCTGCCTGGCCGGCCACTCCCGTCTGCTGTGACGCGCGGACAGAGAG
CTACCGGTGGACCCACGGTGCCTCCCTCCCTGGGATCTACACAGACCATGGCCTTGCCAACGGCTCGACCCCTG
TTGGGGTCCTGTGGGACCCCCGCCCTCGGCAGCCTCCTGTTCCTGCTCTTCAGCCTCGGATGGGTGCAGCCCTC
GAGGACCCTGGCTGGAGAGACAGGGCAGGAGGCTGCACCCCTGGACGGAGTCCTGGCCAACCCACCTAACATTT
CCAGCCTCTCCCCTCGCCAACTCCTTGGCTTCCCGTGTGCGGAGGTGTCCGGCCTGAGCACGGAGCGTGTCCGG
GAGCTGGCTGTGGCCTTGGCACAGAAGAATGTCAAGCTCTCAACAGAGCAGCTGCGCTGTCTGGCTCACCGGCT
CTCTGAGCCCCCGAGGACCTGGACGCCCTCCCATTGGACCTGCTGCTATTCCTCAACCCAGATGCGTTCTCGG
GGCCCCAGGCCTGCACCCGTTTCTTCTCCCGCATCACGAAGGCCAATGTGGACCTGCTCCCGAGGGGGCTCCC
GAGCGACAGCGGCTGCTGCCTGCGGCTCTGGCCTGCTGGGGTGTGCGGGGGTCTCTGCTGAGCGAGGCTGATGT
GCGGGCTCTGGGAGGCCTGGCTTGCGACCTGCCTGGGCGCTTTGTGGCCGAGTCGGCCGAAGTGCTGCTACCCC
GGCTGGTGAGCTGCCCGGGACCCCTGGACCAGGACCAGCAGGAGGCAGCCAGGGCGGCTCTGCAGGGCGGGGGA
CCCCCCTACGGCCCCCGTCGACATGGTCTGTCTCCACGATGGACGCTCTGCGGGGCCTGCTGCCCGTGCTGGG
CCAGCCCATCATCCGCAGCATCCCGCAGGGCATCGTGGCCGCGTGGCGGCAACGCTCCTCTCGGGACCCATCCT
GGCGGCAGCCTGAACGGACCATCCTCCGGCCGCGGTTCCGGCGGGAAGTGGAGAAGACAGCCTGTCCTTCAGGC
AAGAAGGCCCGCGAGATAGACGAGAGCCTCATCTTCTACAAGAAGTGGGAGCTGGAAGCCTGCGTGGATGCGGC
CCTGCTGGCCACCCAGATGGACCGCGTGAACGCCATCCCCTTCACCTACGAGCAGCTGGACGTCCTAAAGCATA
AACTGGATGAGCTCTACCCACAAGGTTACCCCGAGTCTGTGATCCAGCACCTGGGCTACCTCTTCCTCAAGATG
AGCCCTGAGGACATTCGCAAGTGGAATGTGACGTCCCTGGAGACCCTGAAGGCTTTGCTTGAAGTCAACAAAGG
GCACGAAATGAGTCCTCAGGTGGCCACCCTGATCGACCGCTTTGTGAAGGGAAGGGGCCAGCTAGACAAAGACA
CCCTAGACACCCTGACCGCCTTCTACCCTGGGTACCTGTGCTCCCTCAGCCCCGAGGAGCTGAGCTCCGTGCCC
CCCAGCAGCATCTGGGCGGTCAGGCCCCAGGACCTGGACACGTGTGACCCAAGGCAGCTGGACGTCCTCTATCC
CAAGGCCCGCCTTGCTTTCCAGAACATGAACGGGTCCGAATACTTCGTGAAGATCCAGTCCTTCCTGGGTGGGG
CCCCCACGGAGGATTTGAAGGCGCTCAGTCAGCAGAATGTGAGCATGGACTTGGCCACGTTCATGAAGCTGCGG
ACGGATGCGGTGCTGCCGTTGACTGTGGCTGAGGTGCAGAAACTTCTGGGACCCCACGTGGAGGGCCTGAAGGC
GGAGGAGCGGCACCGCCCGGTGCGGGACTGGATCCTACGGCAGCGGCAGGACGACCTGGACACGCTGGGGCTGG
GGCTACAGGGCGGCATCCCCAACGGCTACCTGGTCCTAGACCTCAGCGTGCAAGAGGCCCTCTCGGGGACGCCC
TGCCTCCTAGGACCTGGACCTGTTCTCACCGTCCTGGCACTGCTCCTAGCCTCCACCCTGGCCTGAGGGCCCCA
CTCCCTTGCTGGCCCCAGCCCTGCTGGGGATCCCCGCCTGGCCAGGAGCAGGCACGGGTGATCCCCGTTCCACC
CCAAGAGAACTCGCGCTCAGTAAACGGGAACATGCCCCCTGCAGACACGTAAAAAAAAAAAAAAAAAAA
```

FIGURE 39

TGGGATCTACACAGACCATGGCCTTGCCAACGGCTCGACCCCTGTTGGGGTCCTGTGGGACCCCCGCCCTCGGCAGC
CTCCTGTTCCTGCTCTTCAGCCTCGGATGGGTGCAGCCCTCGAGGACCCTGGCTGGAGAGACAGGGCAGGAGGC
TGCGCCCCTGGACGGAGTCCTGGCCAACCCACCTAACATTTCCAGCCTCTCCCCTCGCCAACTCCTTGGCTTCC
CGTGTGCGGAGGTGTCCGGCCTGAGCACGGAGCGTGTCCGGGAGCTGGCTGTGGCCTTGGCACAGAAGAATGTC
AAGCTCTCAACAGAGCAGCTGCGCTGTCTGGCTCACCGGCTCTCTGAGCCCCCGAGGACCTGGACGCCCTCCC
ATTGGACCTGCTGCTATTCCTCAACCCAGATGCGTTCTCGGGGCCCCAGGCCTGCACCCGTTTCTTCTCCCGCA
TCACGAAGGCCAATGTGGACCTGCTCCCGAGGGGGGCTCCCGAGCGACAGCGGCTGCTGCCTGCGGCTCTGGCC
TGCTGGGGTGTGCGGGGGTCTCTGCTGAGCGAGGCTGATGTGCGGGCTCTGGGAGGCCTGGCTTGCGACCTGCC
TGGGCGCTTTGTGGCCGAGTCGGCCGAAGTGCTGCTACCCCGGCTGGTGAGCTGCCCGGGACCCCTGGACCAGG
ACCAGCAGGAGGCAGCCAGGGCGGCTCTGCAGGGCGGGGACCCCCCTACGGCCCCCGTCGACATGGTCTGTC
TCCACGATGGACGCTCTGCGGGCCTGCTGCCCGTGCTGGGCCAGCCCATCATCCGCAGCATCCGCAGGGCAT
CGTGGCCGCGTGGCGGCAACGCTCCTCTCGGGACCCATCCTGGCGGCAGCCTGAACGGACCATCCTCCGGCCGC
GGTTCCGGCGGGAAGTGGAGAAGACAGCCTGTCCTTCAGGCAAGAAGGCCCGCGAGATAGACGAGAGCCTCATC
TTCTACAAGAAGTGGGAGCTGGAAGCCTGCGTGGATGCGGCCCTGCTGGCCACCCAGATGGACCGCGTGAACGC
CATCCCCTTCACCTACGAGCAGCTGGACGTCCTAAAGCATAAACTGGATGAGCTCTACCCACAAGGTTACCCCG
AGTCTGTGATCCAGCACCTGGGCTACCTCTTCCTCAAGATGAGCCCTGAGGACATTCGCAAGTGGAATGTGACG
TCCCTGGAGACCCTGAAGGCTTTGCTTGAAGTCAACAAAGGGCACGAAATGAGTCCTCAGGTGGCCACCCTGAT
CGACCGCTTTGTGAAGGGAAGGGGCCAGCTAGACAAAGACACCCTAGACACCCTGACCGCCTTCTACCCTGGGT
ACCTGTGCTCCCTCAGCCCCGAGGAGCTGAGCTCCGTGCCCCCCAGCAGCATCTGGGCGGTCAGGCCCCAGGAC
CTGGACACGTGTGACCCAAGGCAGCTGGACGTCCTCTATCCCAAGGCCCGCCTTGCTTTCCAGAACATGAACGG
GTCCGAATACTTCGTGAAGATCCAGTCCTTCCTGGGTGGGCCCCCACGGAGGATTTGAAGGCGCTCAGTCAGC
AGAATGTGAGCATGGACTTGGCCACGTTCATGAAGCTGCGGACGGATGCGGTGCTGCCGTTGACTGTGGCTGAG
GTGCAGAAACTTCTGGGACCCCACGTGGAGGGCCTGAAGGCGGAGGAGCGGCACCGCCCGGTGCGGGACTGGAT
CCTACGGCAGCGGCAGGACGACCTGGACACGCTGGGGCTGGGGCTACAGGGCGGCATCCCCAACGGCTACCTGG
TCCTAGACCTCAGCGTGCAAGAGGCCCTCTCGGGACGCCCTGCCTCCTAGGACCTGGACCTGTTCTCACCGTC
CTGGCACTGCTCCTAGCCTCCACCCTGGCCTGAGGGCCCCACTCCCTTGCTGGCCCCAGCCCTGCTGGGGATCC
CCGCCTGGCCAGGAGCAGGCACGGGTGATCCCCGTTCCACCCCAAGAGAACT

FIGURE 40

```
ATAACAGCATGAAGTGCCGTGGAACTGGAATAGGCGTGTCCTCTCCCTCGACCCTCCCCCTCCTTGTCCCTCTG
CTCACCCCTCGCTCGTTCCCTCCCTCCGGCGAGGGCCGCCTTTATAACAACTGCTCAGAGTGCGAGGGCGGGAT
AGCTGTCCAAGGTCTCCCCCAGCACTGAGGAGCTCGCCTGCTGCCCTCTTGCGCGCGGGAAGCAGCACCAAGTT
CACGGCCAACGCCTTGGCACTAGGGTCCAGAATGGCTACAACAGTCCCTGATGGTTGCCGCAATGGCCTGAAAT
CCAAGTACTACAGACTTTGTGATAAGGCTGAAGCTTGGGGCATCGTCCTAGAAACGGTGGCCACAGCCGGGGTT
GTGACCTCGGTGGCCTTCATGCTCACTCTCCCGATCCTCGTCTGCAAGGTGCAGGACTCCAACAGGCGAAAAT
GCTGCCTACTCAGTTTCTCTTCCTCCTGGGTGTGTTGGGCATCTTTGGCCTCACCTTCGCCTTCATCATCGGAC
TGGACGGGAGCACAGGGCCCACACGCTTCTTCCTCTTTGGGATCCTCTTTTCCATCTGCTTCTCCTGCCTGCTG
GCTCATGCTGTCAGTCTGACCAAGCTCGTCCGGGGAGGAAGCCCCTTTCCCTGTTGGTGATTCTGGGTCTGGC
CGTGGGCTTCAGCCTAGTCCAGGATGTTATCGCTATTGAATATATTGTCCTGACCATGAATAGGACCAACGTCA
ATGTCTTTTCTGAGCTTTCCGCTCCTCGTCGCAATGAAGACTTTGTCCTCCTGCTCACCTACGTCCTCTTCTTG
ATGGCGCTGACCTTCCTCATGTCCTCCTTCACCTTCTGTGGTTCCTTCACGGGCTGGAAGAGACATGGGGCCCA
CATCTACCTCACGATGCTCCTCTCCATTGCCATCTGGGTGGCCTGGATCACCCTGCTCATGCTTCCTGACTTTG
ACCGCAGGTGGGATGACACCATCCTCAGCTCCGCCTTGGCTGCCAATGGCTGGGTGTTCCTGTTGGCTTATGTT
AGTCCCGAGTTTTGGCTGCTCACAAAGCAACGAAACCCCATGGATTATCCTGTTGAGGATGCTTTCTGTAAACC
TCAACTCGTGAAGAAGAGCTATGGTGTGGAGAACAGAGCCTACTCTCAAGAGGAAATCACTCAAGGTTTTGAAG
AGACAGGGGACACGCTCTATGCCCCCTATTCCACACATTTTCAGCTGCAGAACCAGCCTCCCCAAAAGGAATTC
TCCATCCCACGGGCCCACGCTTGGCCGAGCCCTTACAAAGACTATGAAGTAAAGAAAGAGGGCAGCTAACTCTG
TCCTGAAGAGTGGGACAAATGCAGCCGGGCGGCAGATCTAGCGGGAGCTCAAAGGGATGTGGGCGAAATCTTGA
GTCTTCTGAGAAAACTGTACAAGACACTACGGGAACAGTTTGCCTCCCTCCCAGCCTCAACCACAATTCTTCCA
TGCTGGGGCTGATGTGGGCTAGTAAGACTCCAGTTCTTAGAGGCGCTGTAGTATTTTTTTTTTTTGTCTCATC
CTTTGGATACTTCTTTTAAGTGGGAGTCTCAGGCAACTCAAGTTTAGACCCTTACTCTTTTGTTTGTTTTTG
AAACAGGATCTTGCTCTGTCACCCAGGCTTGAGTGCAGTGGTGCGATCACAGCCCAGTGCAGCCTCGACCACCT
GTGCTCAAGCAATCCTCCCATCTCCATCTCCCAAAGTGCTGGGATGACAGGCGTGAGCCACAGCTCCCAGCCTA
GGCCCTTAATCTTGCTGTTATTTTCCATGGACTAAAGGTCTGGTCATCTGAGCTCACGCTGGCTCACACAGCTC
TAGGGGCCTGCTCCTCTAACTCACAGTGGGTTTTGTGAGGCTCTGTGGCCCAGAGCAGACCTGCATATCTGAGC
AAAAATAGCAAAAGCCTCTCTCAGCCCACTGGCCTGAATCTACACTGGAAGCCAACTTGCTGGCACCCCCGCTC
CCCAACCCTTCTTGCCTGGGTAGGAGAGGCTAAAGATCACCCTAAATTTACTCATCTCTCTAGTGCTGCCTCAC
ATTGGGCCTCAGCAGCTCCCCAGCACCAATTCACAGGTCACCCCTCTCTTCTTGCACTGTCCCCAAACTTGCTG
TCAATTCCGAGATCTAATCTCCCCCTACGCTCTGCCAGGAATTCTTTCAGACCTCACTAGCACAAGCCCGGTTG
CTCCTTGTCAGGAGAATTTGTAGATCATTCTCACTTCAAATTCCTGGGGCTGATACTTCTCTCATCTTGCACCC
CAACCTCTGTAAATAGATTTACCGCATTTACGGCTGCATTCTGTAAGTGGGCATGGTCTCCTAATGGAGGAGTG
TTCATTGTATAATAAGTTATTCACCTGAGTATGCAATAAAGATGTGGTGGCCACTCTTTCATGGTGGTGGCAGC
AAAAAAAAAAAAAA
```

FIGURE 41

```
AGAGACTCAAGATGATTCCCTTTTTACCCATGTTTTCTCTACTATTGCTGCTTATTGTTAACCCTATAAACGCC
AACAATCATTATGACAAGATCTTGGCTCATAGTCGTATCAGGGGTCGGGACCAAGGCCCAAATGTCTGTGCCCT
TCAACAGATTTTGGGCACCAAAAAGAAATACTTCAGCACTTGTAAGAACTGGTATAAAAAGTCCATCTGTGGAC
AGAAAACGACTGTTTTATATGAATGTTGCCCTGGTTATATGAGAATGGAAGGAATGAAAGGCTGCCCAGCAGTT
TTGCCCATTGACCATGTTTATGGCACTCTGGGCATCGTGGGAGCCACCACAACGCAGCGCTATTCTGACGCCTC
AAAACTGAGGGAGGAGATCGAGGGAAAGGGATCCTTCACTTACTTTGCACCGAGTAATGAGGCTTGGGACAACT
TGGATTCTGATATCCGTAGAGGTTTGGAGAGCAACGTGAATGTTGAATTACTGAATGCTTTACATAGTCACATG
ATTAATAAGAGAATGTTGACCAAGGACTTAAAAAATGGCATGATTATTCCTTCAATGTATAACAATTTGGGGCT
TTTCATTAACCATTATCCTAATGGGGTTGTCACTGTTAATTGTGCTCGAATCATCCATGGGAACCAGATTGCAA
CAAATGGTGTTGTCCATGTCATTGACCGTGTGCTTACACAAATTGGTACCTCAATTCAAGACTTCATTGAAGCA
GAAGATGACCTTTCATCTTTTAGAGCAGCTGCCATCACATCGGACATATTGGAGGCCCTTGGAAGAGACGGTCA
CTTCACACTCTTTGCTCCCACCAATGAGGCTTTTGAGAAACTTCCACGAGGTGTCCTAGAAAGGTTCATGGGAG
ACAAAGTGGCTTCCGAAGCTCTTATGAAGTACCACATCTTAAATACTCTCCAGTGTTCTGAGTCTATTATGGGA
GGAGCAGTCTTTGAGACGCTGGAAGGAAATACAATTGAGATAGGATGTGACGGTGACAGTATAACAGTAAATGG
AATCAAAATGGTGAACAAAAAGGATATTGTGACAAATAATGGTGTGATCCATTTGATTGATCAGGTCCTAATTC
CTGATTCTGCCAAACAAGTTATTGAGCTGGCTGGAAAACAGCAAACCACCTTCACGGATCTTGTGGCCCAATTA
GGCTTGGCATCTGCTCTGAGGCCAGATGGAGAATACACTTTGCTGGCACCTGTGAATAATGCATTTTCTGATGA
TACTCTCAGCATGGTTCAGCGCCTCCTTAAATTAATTCTGCAGAATCACATATTGAAAGTAAAAGTTGGCCTTA
ATGAGCTTTACAACGGGCAAATACTGGAAACCATCGGAGGCAAACAGCTCAGAGTCTTCGTATATCGTACAGCT
GTCTGCATTGAAAATTCATGCATGGAGAAAGGGAGTAAGCAAGGGAGAAACGGTGCGATTCACATATTCCGCGA
GATCATCAAGCCAGCAGAGAAATCCCTCCATGAAAAGTTAAAACAAGATAAGCGCTTTAGCACCTTCCTCAGCC
TACTTGAAGCTGCAGACTTGAAAGAGCTCCTGACACAACCTGGAGACTGGACATTATTTGTGCCAACCAATGAT
GCTTTTAAGGGAATGACTAGTGAAGAAAAGAAATTCTGATACGGGACAAAAATGCTCTTCAAAACATCATTCT
TTATCACCTGACACCAGGAGTTTTCATTGGAAAAGGATTTGAACCTGGTGTTACTAACATTTTAAAGACCACAC
AAGGAAGCAAAATCTTTCTGAAAGAAGTAAATGATACACTTCTGGTGAATGAATTGAAATCAAAAGAATCTGAC
ATCATGACAACAAATGGTGTAATTCATGTTGTAGATAAACTCCTCTATCCAGCAGACACACCTGTTGGAAATGA
TCAACTGCTGGAAATACTTAATAAATTAATCAAATACATCCAAATTAAGTTTGTTCGTGGTAGCACCTTCAAAG
AAATCCCCGTGACTGTCTATACAACTAAAATTATAACCAAAGTTGTGGAACCAAAAATTAAAGTGATTGAAGGC
AGTCTTCAGCCTATTATCAAAACTGAAGGACCCACACTAACAAAAGTCAAAATTGAAGGTGAACCTGAATTCAG
ACTGATTAAAGAAGGTGAAACAATAACTGAAGTGATCCATGGAGAGCCAATTATTAAAAAATACACCAAAATCA
TTGATGGAGTGCCTGTGGAAATAACTGAAAAAGAGACACGAGAAGAACGAATCATTACAGGTCCTGAAATAAAA
TACACTAGGATTTCTACTGGAGGTGGAGAAACAGAAGAAACTCTGAAGAAATTGTTACAAGAAGAGGTCACCAA
GGTCACCAAATTCATTGAAGGTGGTGATGGTCATTTATTTGAAGATGAAGAAATTAAAAGACTGCTTCAGGGAG
ACACACCCGTGAGGAAGTTGCAAGCCAACAAAAAAGTTCAAGGTTCTAGAAGACGATTAAGGGAAGGTCGTTCT
CAGTGAAAATCCAAAAACCAGAAAAAAATGTTTATACAACCCTAAGTCAATAACCTGACCTTAGAAAATTGTGA
GAGCCAAGTTGACTTCAGGAACTGAAACATCAGCACAAAGAAGCAATCATCAAATAATTCTGAACACAAATTTA
ATATTTTTTTTCTGAATGAGAAACATGAGGGAAATTGTGGAGTTAGCCTCCTGTGGTAAAGGAATTGAAGAAA
ATATAACACCTTACACCCTTTTTCATCTTGACATTAAAAGTTCTGGCTAACTTTGGAATCCATTAGAGAAAAAT
CCTTGTCACCAGATTCATTACAATTCAAATCGAAGAGTTGTGAACTGTTATCCCATTGAAAAGACCGAGCCTTG
TATGTATGTTATGGATACATAAATGCACGCAAGCCATTATCTCTCCATGGGAAGCTAAGTTATAAAAATAGGT
GCTTGGTGTACAAAACTTTTTATATCAAAGGCTTTGCACATTTCTATATGAGTGGGTTTACTGGTAAATTATG
TTATTTTTTACAACTAATTTTGTACTCTCAGAATGTTTGTCATATGCTTCTTGCAATGCATATTTTTAATCTC
AAACGTTTCAATAAAACCATTTTTCAGATATAAAGAGAATTACTTCAAATTGAGTAATTCAGAAAAACTCAAGA
TTTAAGTTAAAAAGTGGTTTGGACTTGGGAA
```

FIGURE 42

CCCTTGAGACTCAAG<u>ATG</u>ATTCCCTTTTTACCCATGTTTTCTCTACTATTGCTGCTTATTGTTAACCCTATAAA
CGCCAACAATCATTATGACAAGATCTTGGCTCATAGTCGTATCAGGGGTCGGGACCAAGGCCCAAATGTCTGTG
CCCTTCAACAGATTTTGGGCACCAAAAAGAAATACTTCAGCACTTGTAAGAACTGGTATAAAAAGTCCATCTGT
GGACAGAAAACGACTGTGTTATATGAATGTTGCCCTGGTTATATGAGAATGGAAGGAATGAAAGGCTGCCCAGC
AGTTTTGCCCATTGACCATGTTTATGGCACTCTGGGCATCGTGGGAGCCACCACAACGCAGCGCTATTCTGACG
CCTCAAAACTGAGGGAGGAGATCGAGGGAAAGGGATCCTTCACTTACTTTGCACCGAGTAATGAGGCTTGGGAC
AACTTGGATTCTGATATCCGTAGAGGTTTGGAGAGCAACGTGAATGTTGAATTACTGAATGCTTTACATAGTCA
CATGATTAATAAGAGAATGTTGACCAAGGACTTAAAAAATGGCATGATTATTCCTTCAATGTATAACAATTTGG
GGCTTTTCATTAACCATTATCCTAATGGGGTTGTCACTGTTAATTGTGCTCGAATCATCCATGGGAACCAGATT
GCAACAAATGGTGTTGTCCATGTCATTGACCGTGTGCTTACACAAATTGGTACCTCAATTCAAGACTTCATTGA
AGCAGAAGATGACCTTTCATCTTTTAGAGCAGCTGCCATCACATCGGACATATTGGAGGCCCTTGGAAGAGACG
GTCACTTCACACTCTTTGCTCCCACCAATGAGGCTTTTGAGAAACTTCCACGAGGTGTCCTAGAAAGGATCATG
GGAGACAAAGTGGCTTCCGAAGCTCTTATGAAGTACCACATCTTAAATACTCTCCAGTGTTCTGAGTCTATTAT
GGGAGGAGCAGTCTTTGAGACGCTGGAAGGAAATACAATTGAGATAGGATGTGACGGTGACAGTATAACAGTAA
ATGGAATCAAATGGTGAACAAAAAGGATATTGTGACAAATAATGGTGTGATCCATTTGATTGATCAGGTCCTA
ATTCCTGATTCTGCCAAACAAGTTATTGAGCTGGCTGGAAAACAGCAAACCACCTTCACGGATCTTGTGGCCCA
ATTAGGCTTGGCATCTGCTCTGAGGCCAGATGGAGAATACACTTTGCTGGCACCTGTGAATAATGCATTTTCTG
ATGATACTCTCAGCATGGATCAGCGCCTCCTTAAATTAATTCTGCAGAATCACATATTGAAAGTAAAAGTTGGC
CTTAATGAGCTTTACAACGGGCAAATACTGGAAACCATCGGAGGCAAACAGCTCAGAGTCTTCGTATATCGTAC
AGCTGTCTGCATTGAAAATTCATGCATGGAGAAAGGGAGTAAGCAAGGGAGAAACGGTGCGATTCACATATTCC
GCGAGATCATCAAGCCAGCAGAGAAATCCCTCCATGAAAAGTTAAAACAAGATAAGCGCTTTAGCACCTTCCTC
AGCCTACTTGAAGCTGCAGACTTGAAAGAGCTCCTGACACAACCTGGAGACTGGACATTATTTGTGCCAACCAA
TGATGCTTTTAAGGGAATGACTAGTGAAGAAAAGAAATTCTGATACGGGACAAAAATGCTCTTCAAAACATCA
TTCTTTATCACCTGACACCAGGAGTTTTCATTGGAAAAGGATTTGAACCTGGTGTTACTAACATTTTAAAGACC
ACACAAGGAAGCAAATCTTTCTGAAAGAAGTAAATGATACACTTCTGGTGAATGAATTGAAATCAAAAGAATC
TGACATCATGACAACAAATGGTGTAATTCATGTTGTAGATAAACTCCTCTATCCAGCAGACACACCTGTTGGAA
ATGATCAACTGCTGGAAATACTTAATAAATTAATCAAATACATCCAAATTAAGTTTGTTCGTGGTAGCACCTTC
AAAGAAATCCCCGTGACTGTCTATAGACCCACACTAACAAAAGTCAAAATTGAAGGTGAACCTGAATTCAGACT
GATTAAAGAAGGTGAAACAATAACTGAAGTGATCCATGGAGAGCCAATTATTAAAAAATACACCAAAATCATTG
ATGGAGTGCCTGTGGAAATAACTGAAAAAGAGACACGAGAAGAACGAATCATTACAGGTCCTGAAATAAAATAC
ACTAGGATTTCTACTGGAGGTGGAGAAACAGAAGAAACTCTGAAGAAATTGTTACAAGAAGAGGTCACCAAGGT
CACCAAATTCATTGAAGGTGGTGATGGTCATTTATTTGAAGATGAAGAAATTAAAAGACTGCTTCAGGGAGACA
CACCCGTGAGGAAGTTGCAAGCCAACAAAAAAGTTCAAGGATCTAGAAGACGATTAAGGGAAGGTCGTTCTCAG
<u>TGA</u>AGGGC

FIGURE 43

CCCTTGAGACTCAAGATGATTCCCTTTTTACCCATGTTTTCTCTACTATTGCTGCTTATTGTTAACCCTATAAA
CGCCAACAATCATTATGACAAGATCTTGGCTCATAGTCGTATCAGGGGTCGGGACCAAGGCCCAAATGTCTGTG
CCCTTCAACAGATTTTGGGCACCAAAAAGAAATACTTCAGCACTTGTAAGAACTGGTATAAAAAGTCCATCTGT
GGACAGAAAACGACTGTGTTATATGAATGTTGCCCTGGTTATATGAGAATGGAAGGAATGAAAGGCTGCCCAGC
AGTTTTGCCCATTGACCATGTTTATGGCACTCTGGGCATCGTGGGAGCCACCACAACGCAGCGCTATTCTGACG
CCTCAAAACTGAGGGAGGAGATCGAGGGAAAGGGATCCTTCACTTACTTTGCACCGAGTAATGAGGCTTGGGAC
AACTTGGATTCTGATATCCGTAGAGGTTTGGAGAGCAACGTGAATGTTGAATTACTGAATGCTTTACATAGTCA
CATGATTAATAAGAGAATGTTGACCAAGGACTTAAAAAATGGCATGATTATTCCTTCAATGTATAACAATTTGG
GGCTTTTCATTAACCATTATCCTAATGGGGTTGTCACTGTTAATTGTGCTCGAATCATCCATGGGAACCAGATT
GCAACAAATGGTGTTGTCCATGTCATTGACCGTGTGCTTACACAAATTGGTACCTCAATTCAAGACTTCATTGA
AGCAGAAGATGACCTTTCATCTTTTAGAGCAGCTGCCATCACATCGGACATATTGGAGGCCCTTGGAAGAGACG
GTCACTTCACACTCTTTGCTCCCACCAATGAGGCTTTTGAGAAACTTCCACGAGGTGTCCTAGAAAGGATCATG
GGAGACAAAGTGGCTTCCGAAGCTCTTATGAAGTACCACATCTTAAATACTCTCCAGTGTTCTGAGTCTATTAT
GGGAGGAGCAGTCTTTGAGACGCTGGAAGGAAATACAATTGAGATAGGATGTGACGGTGACAGTATAACAGTAA
ATGGAATCAAAATGGTGAACAAAAAGGATATTGTGACAAATAATGGTGTGATCCATTTGATTGATCAGGTCCTA
ATTCCTGATTCTGCCAAACAAGTTATTGAGCTGGCTGGAAAACAGCAAACCACCTTCACGGATCTTGTGGCCCA
ATTAGGCTTGGCATCTGCTCTGAGGCCAGATGGAGAATACACTTTGCTGGCACCTGTGAATAATGCATTTTCTG
ATGATACTCTCAGCATGGATCAGCGCCTCCTTAAATTAATTCTGCAGAATCACATATTGAAAGTAAAAGTTGGC
CTTAATGAGCTTTACAACGGGCAAATACTGGAAACCATCGGAGGCAAACAGCTCAGAGTCTTCGTATATCGTAC
AGCTGTCTGCATTGAAAATTCATGCATGGAGAAAGGGAGTAAGCAAGGGAGAAACGGTGCGATTCACATATTCC
GCGAGATCATCAAGCCAGCAGAGAAATCCCTCCATGAAAAGTTAAAACAAGATAAGCGCTTTAGCACCTTCCTC
AGCCTACTTGAAGCTGCAGACTTGAAAGAGCTCCTGACACAACCTGGAGACTGGACATTATTTGTGCCAACCAA
TGATGCTTTTAAGGGAATGACTAGTGAAGAAAAGAAATTCTGATACGGGACAAAAATGCTCTTCAAAACATCA
TTCTTTATCACCTGACACCAGGAGTTTTCATTGGAAAAGGATTTGAACCTGGTGTTACTAACATTTTAAAGACC
ACACAAGGAAGCAAAATCTTTCTGAAAGAAGTAAATGATACACTTCTGGTGAATGAATTGAAATCAAAAGAATC
TGACATCATGACAACAAATGGTGTAATTCATGTTGTAGATAAACTCCTCTATCCAGCAGACACACCTGTTGGAA
ATGATCAACTGCTGGAAATACTTAATAAATTAATCAAATACATCCAAATTAAGTTTGTTCGTGGTAGCACCTTC
AAAGAAATCCCCGTGACTGTCTATAAGCCAATTATTAAAAAATACACCAAAATCATTGATGGAGTGCCTGTGGA
AATAACTGAAAAAGAGACACGAGAAGAACGAATCATTACAGGTCCTGAAATAAAATACACTAGGATTTCTACTG
GAGGTGGAGAAACAGAAGAAACTCTGAAGAAATTGTTACAAGAAGACACACCCGTGAGGAAGTTGCAAGCCAAC
AAAAAAGTTCAAGGATCTAGAAGACGATTAAGGGAAGGTCGTTCTCAGTGAAGGGC

FIGURE 44

```
CCCTTGAGACTCAAGATGATTCCCTTTTTACCCATGTTTTCTCTACTATTGCTGCTTATTGTTAACCCTATAAA
CGCCAACAATCATTATGACAAGATCTTGGCTCATAGTCGTATCAGGGGTCGGGACCAAGGCCCAAATGTCTGTG
CCCTTCAACAGATTTTGGGCACCAAAAAGAAATACTTCAGCACTTGTAAGAACTGGTATAAAAAGTCCATCTGT
GGACAGAAAACGACTGTGTTATATGAATGTTGCCCTGGTTATATGAGAATGGAAGGAATGAAAGGCTGCCCAGC
AGTTTTGCCCATTGACCATGTTTATGGCACTCTGGGCATCGTGGGAGCCACCACAACGCAGCGCTATTCTGACG
CCTCAAAACTGAGGGAGGAGATCGAGGGAAAGGGATCCTTCACTTACTTTGCACCGAGTAATGAGGCTTGGGAC
AACTTGGATTCTGATATCCGTAGAGGTTTGGAGAGCAACGTGAATGTTGAATTACTGAATGCTTTACATAGTCA
CATGATTAATAAGAGAATGTTGACCAAGGACTTAAAAAATGGCATGATTATTCCTTCAATGTATAACAATTTGG
GGCTTTTCATTAACCATTATCCTAATGGGGTTGTCACTGTTAATTGTGCTCGAATCATCCATGGGAACCAGATT
GCAACAAATGGTGTTGTCCATGTCATTGACCGTGTGCTTACACAAATTGGTACCTCAATTCAAGACTTCATTGA
AGCAGAAGATGACCTTTCATCTTTTAGAGCAGCTGCCATCACATCGGACATATTGGAGGCCCTTGGAAGAGACG
GTCACTTCACACTCTTTGCTCCCACCAATGAGGCTTTTGAGAAACTTCCACGAGGTGTCCTAGAAAGGATCATG
GGAGACAAAGTGGCTTCCGAAGCTCTTATGAAGTACCACATCTTAAATACTCTCCAGTGTTCTGAGTCTATTAT
GGGAGGAGCAGTCTTTGAGACGCTGGAAGGAAATACAATTGAGATAGGATGTGACGGTGACAGTATAACAGTAA
ATGGAATCAAAATGGTGAACAAAAAGGATATTGTGACAAATAATGGTGTGATCCATTTGATTGATCAGGTCCTA
ATTCCTGATTCTGCCAAACAAGTTATTGAGCTGGCTGGAAAACAGCAAACCACCTTCACGGATCTTGTGGCCCA
ATTAGGCTTGGCATCTGCTCTGAGGCCAGATGGAGAATACACTTTGCTGGCACCTGTGAATAATGCATTTCTG
ATGATACTCTCAGCATGGATCAGCGCCTCCTTAAATTAATTCTGCAGAATCACATATTGAAAGTAAAAGTTGGC
CTTAATGAGCTTTACAACGGGCAAATACTGGAAACCATCGGAGGCAAACAGCTCAGAGTCTTCGTATATCGTAC
AGCTGTCTGCATTGAAAATTCATGCATGGAGAAAGGGAGTAAGCAAGGGAGAAACGGTGCGATTCACATATTCC
GCGAGATCATCAAGCCAGCAGAGAAATCCCTCCATGAAAAGTTAAAACAAGATAAGCGCTTTAGCACCTTCCTC
AGCCTACTTGAAGCTGCAGACTTGAAAGAGCTCCTGACACAACCTGGAGACTGGACATTATTTGTGCCAACCAA
TGATGCTTTTAAGGGAATGACTAGTGAAGAAAAGAAATTCTGATACGGGACAAAAATGCTCTTCAAAACATCA
TTCTTTATCACCTGACACCAGGAGTTTTCATTGGAAAAGGATTTGAACCTGGTGTTACTAACATTTTAAAGACC
ACACAAGGAAGCAAAATCTTTCTGAAAGAAGTAAATGATACACTTCTGGTGAATGAATTGAAATCAAAAGAATC
TGACATCATGACAACAAATGGTGTAATTCATGTTGTAGATAAACTCCTCTATCCAGCAGACACACCTGTTGGAA
ATGATCAACTGCTGGAAATACTTAATAAATTAATCAAATACATCCAAATTAAGTTTGTTCGTGGTAGCACCTTC
AAAGAAATCCCCGTGACTGTCTATAGACCCACACTAACAAAAGTCAAAATTGAAGGTGAACCTGAATTCAGACT
GATTAAAGAAGGTGAAACAATAACTGAAGTGATCCATGGAGAGCCAATTATTAAAAAATACACCAAAATCATTG
ATGGAGTGCCTGTGGAAATAACTGAAAAAGAGACACGAGAAGAACGAATCATTACAGGTCCTGAAATAAAATAC
ACTAGGATTTCTACTGGAGGTGGAGAAACAGAAGAAACTCTGAAGAAATTGTTACAAGAAGACACACCCGTGAG
GAAGTTGCAAGCCAACAAAAAAGTTCAAGGATCTAGAAGACGATTAAGGGAAGGTCGTTCTCAGTGAAGGGC
```

FIGURE 45

CCCTTGAGACTCAAG<u>ATG</u>ATTCCCTTTTTACCCATGTTTTCTCTACTATTGCTGCTTATTGTTAACCCTATAAA
CGCCAACAATCATTATGACAAGATCTTGGCTCATAGTCGTATCAGGGGTCGGGACCAAGGCCCAAATGTCTGTG
CCCTTCAACAGATTTTGGGCACCAAAAAGAAATACTTCAGCACTTGTAAGAACTGGTATAAAAAGTCCATCTGT
GGACAGAAAACGACTGTGTTATATGAATGTTGCCCTGGTTATATGAGAATGGAAGGAATGAAAGGCTGCCCAGC
AGTTTTGCCCATTGACCATGTTTATGGCACTCTGGGCATCGTGGGAGCCACCACAACGCAGCGCTATTCTGACG
CCTCAAAACTGAGGGAGGAGATCGAGGGAAAGGGATCCTTCACTTACTTTGCACCGAGTAATGAGGCTTGGGAC
AACTTGGATTCTGATATCCGTAGAGGTTTGGAGAGCAACGTGAATGTTGAATTACTGAATGCTTTACATAGTCA
CATGATTAATAAGAGAATGTTGACCAAGGACTTAAAAAATGGCATGATTATTCCTTCAATGTATAACAATTTGG
GGCTTTTCATTAACCATTATCCTAATGGGGTTGTCACTGTTAATTGTGCTCGAATCATCCATGGGAACCAGATT
GCAACAAATGGTGTTGTCCATGTCATTGACCGTGTGCTTACACAAATTGGTACCTCAATTCAAGACTTCATTGA
AGCAGAAGATGACCTTTCATCTTTTAGAGCAGCTGCCATCACATCGGACATATTGGAGGCCCTTGGAAGAGACG
GTCACTTCACACTCTTTGCTCCCACCAATGAGGCTTTTGAGAAACTTCCACGAGGTGTCCTAGAAAGGATCATG
GGAGACAAAGTGGCTTCCGAAGCTCTTATGAAGTACCACATCTTAAATACTCTCCAGTGTTCTGAGTCTATTAT
GGGAGGAGCAGTCTTTGAGACGCTGGAAGGAAATACAATTGAGATAGGATGTGACGGTGACAGTATAACAGTAA
ATGGAATCAAAATGGTGAACAAAAAGGATATTGTGACAAATAATGGTGTGATCCATTTGATTGATCAGGTCCTA
ATTCCTGATTCTGCCAAACAAGTTATTGAGCTGGCTGGAAAACAGCAAACCACCTTCACGGATCTTGTGGCCCA
ATTAGGCTTGGCATCTGCTCTGAGGCCAGATGGAGAATACACTTTGCTGGCACCTGTGAATAATGCATTTTCTG
ATGATACTCTCAGCATGGATCAGCGCCTCCTTAAATTAATTCTGCAGAATACACATATTGAAAGTAAAAGTTGGC
CTTAATGAGCTTTACAACGGGCAAATACTGGAAACCATCGGAGGCAAACAGCTCAGAGTCTTCGTATATCGTAC
AGCTGTCTGCATTGAAAATTCATGCATGGAGAAAGGGAGTAAGCAAGGGAGAAACGGTGCGATTCACATATTCC
GCGAGATCATCAAGCCAGCAGAGAAATCCCTCCATGAAAAGTTAAAACAAGATAAGCGCTTTAGCACCTTCCTC
AGCCTACTTGAAGCTGCAGACTTGAAAGAGCTCCTGACACAACCTGGAGACTGGACATTATTTGTGCCAACCAA
TGATGCTTTTAAGGGAATGACTAGTGAAGAAAAGAAATTCTGATACGGGACAAAAATGCTCTTCAAAACATCA
TTCTTTATCACCTGACACCAGGAGTTTTCATTGGAAAAGGATTTGAACCTGGTGTTACTAACATTTTAAAGACC
ACACAAGGAAGCAAAATCTTTCTGAAAGAAGTAAATGATACACTTCTGGTGAATGAATTGAAATCAAAAGAATC
TGACATCATGACAACAAATGGTGTAATTCATGTTGTAGATAAACTCCTCTATCCAGCAGACACACCTGTTGGAA
ATGATCAACTGCTGGAAATACTTAATAAATTAATCAAATACATCCAAATTAAGTTTGTTCGTGGTAGCACCTTC
AAAGAAATCCCCGTGACTGTCTATAAGCCAATTATTAAAAAATACACCAAAATCATTGATGGAGTGCCTGTGGA
AATAACTGAAAAGAGACACGAGAAGAACGAATCATTACAGGTCCTGAAATAAAATACACTAGGATTTCTACTG
GAGGTGGAGAAACAGAAGAAACTCTGAAGAAATTGTTACAAGAAGAGGTCACCAAGGTCACCAAATTCATTGAA
GGTGGTGATGGTCATTTATTTGAAGATGAAGAAATTAAAAGACTGCTTCAGGGAGACACACCCGTGAGGAAGTT
GCAAGCCAACAAAAAAGTTCAAGGATCTAGAAGACGATTAAGGGAAGGTCGTTCTCAG<u>TGA</u>AGGGC

FIGURE 46

ACACGGACCAAGGAGTCTAACACGTGCGCGAGTCGGGGGCTCGCACGAAAGCCGCCGTGGCGCAATGAAGGTGA
AGGCCGGCGCGCTCGCCGGCCGAGGTGGGATCCCGAGGCCTCTCCAGTCCGCCGAGGGCGCACCACCGGCCCGT
CTCGCCCGCCGCGCCGGGGAGGTGGAGCACGAGCGCACGTGTTAGGACCCGAAAGATGGTGAACTATGCCTGGG
CAGGGCGAAGCCAGAGGAAACTCTGGTGGAGGTCCGTAGCGGTCCTGACGTGCAAATCGGTCGTCCGACCTGGG
TATAGGGGCGGGCTCCAGGCGAGGCGGTCGACGCTCCTGAAAACTTGCGCGCGCGCTCGCGCCACTGCGCCCGG
AGCGATGAAGATGGTCGCGCCCTGGACGCGGTTCTACTCCAACAGCTGCTGCTTGTGCTGCCATGTCCGCACCG
GCACCATCCTGCTCGGCGTCTGGTATCTGATCATCAATGCTGTGGTACTGTTGATTTTATTGAGTGCCCTGGCT
GATCCGGATCAGTATAACTTTTCAAGTTCTGAACTGGGAGGTGACTTTGAGTTCATGGATGATGCCAACATGTG
CATTGCCATTGCGATTTCTCTTCTCATGATCCTGATATGTGCTATGGCTACTTACGGAGCGTACAAGCAACGCG
CAGCCTGGATCATCCCATTCTTCTGTTACCAGATCTTTGACTTTGCCCTGAACATGTTGGTTGCAATCACTGTG
CTTATTTATCCAAACTCCATTCAGGAATACATACGGAACTGCCTCCTAATTTTCCCTACAGAGATGATGTCAT
GTCAGTGAATCCTACCTGTTTGGTCCTTATTATTCTTCTGTTTATTAGCATTATCTTGACTTTTAAGGGTTACT
TGATTAGCTGTGTTTGGAACTGCTACCGATACATCAATGGTAGGAACTCCTCTGATGTCCTGGTTTATGTTACC
AGCAATGACACTACGGTGCTGCTACCCCCGTATGATGATGCCACTGTGAATGGTGCTGCCAAGGAGCCACCGCC
ACCTTACGTGTCTGCCTAAGCCTTCAAGTGGGCGGAGCTGAGGGCAGCAGCTTGACTTTGCAGACATCTGAGCA
ATAGTTCTGTTATTTCACTTTTGCCATGAGCCTCTCTGAGCTTGTTTGTTGCTGAAATGCTACTTTTTAAAATT
TAGATGTTAGATTGAAAACTGTAGTTTTCAACATATGCTTTGCTAGAACACTGTGATAGATTAACTGTAGAATT
CTTCCTGTACGATTGGGGATATAATGGGCTTCACTAACCTTCCCTAGGCATTGAAACTTCCCCCAAATCTGATG
GACCTAGAAGTCTGCTTTTGTACCTGCTGGGCCCCAAAGTTGGGCATTTTTCTCTCTGTTCCCTCTCTTTTGAA
AATGTAAAATAAAACCAAAATAGACAACTTTTTCTTCAGCCATTCCAGCATAGAGAACAAAACCTTATGGAAA
CAGGAATGTCAATTGTGTAATCATTGTTCTAATTAGGTAAATAGAAGTCCTTATGTATGTGTTACAAGAATTTC
CCCCACAACATCCTTTATGACTGAAGTTCAATGACAGTTTGTGTTTGGGTGGTAAAGGATTTTCTCCATGGCCT
GAATTAAGACCATTAGAAAGCACCAGGCCGTGGGAGCAGTGACCATCTGCTGACTGTTCTTGTGGATCTTGTGT
CCAGGGACATGGGGTGACATGCCTCGTATGTGTTAGAGGGTGGAATGGATGTGTTTGGCGCTGCATGGGATCTG
GTGCCCCTCTTCTCCTGGATTCACATCCCCACCCAGGGCCCGCTTTTACTAAGTGTTCTGCCCTAGATTGGTTC
AAGGAGGTCATCCAACTGACTTTATCAAGTGGAATTGGGATATATTTGATATACTTCTGCCTAACAACATGGAA
AAGGGTTTTCTTTTCCCTGCAAGCTACATCCTACTGCTTTGAACTTCCAAGTATGTCTAGTCACCTTTTAAAAT
GTAAACATTTTCAGAAAAATGAGGATTGCCTTCCTTGTATGCGCTTTTTACCTTGACTACCTGAATTGCAAGGG
ATTTTTATATATTCATATGTTACAAAGTCAGCAACTCTCCTGTTGGTTCATTATTGAATGTGCTGTAAATTAAG
TTGTTTGCAATTAAAACAAGGTTTGCCCACAAAAAAAAAA

FIGURE 47

ATTCGCCCTTCCGAAAGATGGTGAACTATGCCTGGGCAGGGCGGGCTCCAGGCGAGGCGGTCGACGCTCCTGAA
AACTTGCGCGCGCGCTCGCGCCACTGCGCCCGGAGCGATGAAGATGGTCGCGCCCTGGACTCGGTTCTACTCCA
ACAGCTGCTGCTTGTGCTGCCATGTCCGCACCGGCACCATCCTGCTCGGCGTCTGGTATCTGATCATCAATGCT
GTGGTACTGTTGATTTTATTGAGTGCCCTGGCTGATCCGGATCAGTATAACTTTTCAAGTTCTGAACTGGGAGG
TGACTTTGAGTTCATGGATGATGCCAACATGTGCATTGCCATTGCGATTTCTCTTCTCATGATCCTGATATGTG
CTATGGCTACTTACGGAGCGTACAAGCAACGCGCAGCCTGGATCATCCCATTCTTCTGTTACCAGATCTTTGAC
TTTGCCCTGAACATGTTGGTTGCAATCACTGTGCTTATTTATCCAAACTCCATTCAGGAATACATACGGCAACT
GCCTCCTAATTTTCCCTACAGAGATGATGTCATGTCAGTGAATCCTACCTGTTTGGTCCTTATTATTCTTCTGT
TTATTAGCATTATCTTGACTTTTAAGGGTTACTTGATTAGCTGTGTTTGGAACTGCTACCGATACATCAATGGT
AGGAACTCCTCTGATGTCCTGGTTTATGTTACCAGCAATGACACTACGGTGCTGCTACCCCCGTATGATGATGC
CACTGTGAATGGTGCTGCCAAGGAGCCACCGCCACCTTACGTGTCTGCCTAAGCCTTCAAGTGGGCGGAGCTGA
GGGCAGCAGCTTGACTTTGCAGACATCTGAGAAGGGC

FIGURE 48

AGCGCCATGGGGCGAGCCGGGGGCGGGGGCCCGGGCCGGGGCCGCCGCCACTGCTGCTGTTTCTGGGGGCCGC
GCTGGTCCTGGCCTCTGGGGCCGTGCCGGCGCGTGAGGCGGGCAGCGCGGTTGAGGCCGAAGAGCTGGTGAAGG
GCAGCCCGGCGTGGGAGCCGCCTGCCAACGACACGCGGGAAGAAGCCGGCCCACCAGCGGCTGGGGAAGATGAG
GCGTCGTGGACGGCGCCCGGTGGCGAGCTGGCCGGGCCAGAAGAGGTGCTGCAGGAGTCGGCTGCGGTGACCGG
CACCGCCTGGCTGGAAGCTGACAGCCCAGGCCTGGGAGGAGTGACCGCAGAGGCGGGCAGCGGCGATGCCCAGG
CCCTTCCAGCTACGCTCCAGGCTCCCCACGAGGTCCTCGGGCAGTCAATCATGCCCCCTGCCATTCCTGAGGCT
ACAGAGGCCAGCGGGCCACCCTCCCCACCCCCGGCGACAAGCTGAGCCCAGCTTCTGAACTCCCCAAGGAGAG
CCCCTTGGAGGTTTGGCTGAACCTGGGGGGCAGCACACCCGACCCTCAAGTGCCAGAGCTGACTTACCCATTTC
AGGGCACCCTGGAGCCCCAACCGGCATCAGATATCATTGACATCGACTACTTCGAAGGACTGGATGGTGAGGGT
CGTGGCGCAGATCTGGGGAGCTTCCCAGGGTCACCAGGAACCTCAGAGAACCACCCTGATACTGAGGGAGAGAC
CCCTTCCTGGAGCCTGCTTGACTTATACGATGATTTCACCCCCTTCGATGAATCTGATTTCTACCCCACCACAT
CCTTTTATGATGACTTGGATGAAGAGGAGGAGGAAGAGGAGGATGACAAAGATGCAGTAGGAGGTGGAGACCTA
GAAGATGAAAATGAGCTTCTAGTGCCCACTGGGAAGCCTGGTCTGGGGCCCGGGACAGGCCAGCCCACCAGTCG
GTGGCATGCTGTCCCTCCACAGCACACTCTGGGGTCGGTCCCCGGCAGCAGCATCGCCCTCAGGCCCCGCCCAG
GAGAGCCAGGCAGGGACTTGGCCTCCAGTGAAAATGGCACTGAGTGCCGCAGTGGCTTTGTGCGGCATAACGGC
TCCTGCCGGTCAGTGTGCGACCTCTTCCCAAGTTACTGTCACAATGGCGGCCAGTGCTACCTGGTGGAGAACAT
AGGGGCCTTCTGCAGGTGCAACACGCAGGACTACATCTGGCACAAGGGGATGCGCTGCGAGTCCATCATCACCG
ACTTCCAGGTGATGTGCGTGGCCGTGGGCTCGGCTGCCCTCGTCCTGCTCCTGCTCTTCATGATGACGGTGTTC
TTTGCCAAGAAGCTCTACCTGCTCAAGACGGAGAATACCAAGCTGCGTAGGACCAACAAATTCCGGACCCCATC
TGAGCTCCACAATGATAACTTCTCCCTCTCCACCATTGCCGAGGGCTCTCACCCAAATGATGATCCTAGTGCTC
CCCACAAAATCCAGGAGGTTCTCAAGTCCTGCCTGAAAGAGGAGGAGTCATTTAACATCCAGAACTCCATGTCG
CCCAAACTTGAGGGTGGCAAAGGTGACCAGGCTGACTTGGATGTGAACTGTCTTCAGAATAATTTAACCTAAAG
CAGAGCAAGAAGAGAGGAAGCGGGGTAGTGGGTGGGGTAGGGAAGAAACATTATCTCCTCTTGTACAGAGTCT
ATTTCTTGTAACCATTTGTTAAACTC

FIGURE 49

```
GGACAGGCGTGGCGGCCGGAGCCCCAGCATCCCTGCTTGAGGTCCAGGAGCGGAGCCCGCGGCCACCGCCGCCT
GATCAGCGCGACCCCGGCCCGCGCCCGCCCCGCCCGGCAAGATGCTGCCCGTGTACCAGGAGGTGAAGCCCAAC
CCGCTGCAGGACGCGAACATCTGCTCACGCGTGTTCTTCTGGTGGCTCAATCCCTTGTTTAAAATTGGCCATAA
ACGGAGATTAGAGGAAGATGATATGTATTCAGTGCTGCCAGAAGACCGCTCACAGCACCTTGGAGAGGAGTTGC
AAGGGTTCTGGGATAAAGAAGTTTTAAGAGCTGAGAATGACGCACAGAAGCCTTCTTTAACAAGAGCAATCATA
AAGTGTTACTGGAAATCTTATTTAGTTTTGGGAATTTTTACGTTAATTGAGGAAAGTGCCAAAGTAATCCAGCC
CATATTTTTGGGAAAAATTATTAATTATTTTGAAAATTATGATCCCATGGATTCTGTGGCTTTGAACACAGCGT
ACGCCTATGCCACGGTGCTGACTTTTTGCACGCTCATTTTGGCTATACTGCATCACTTATATTTTATCACGTT
CAGTGTGCTGGGATGAGGTTACGAGTAGCCATGTGCCATATGATTTATCGGAAGGCACTTCGTCTTAGTAACAT
GGCCATGGGGAAGACAACCACAGGCCAGATAGTCAATCTGCTGTCCAATGATGTGAACAAGTTTGATCAGGTGA
CAGTGTTCTTACACTTCCTGTGGGCAGGACCACTGCAGGCGATCGCAGTGACTGCCCTACTCTGGATGGAGATA
GGAATATCGTGCCTTGCTGGGATGGCAGTTCTAATCATTCTCCTGCCCTTGCAAAGCTGTTTTGGGAAGTTGTT
CTCATCACTGAGGAGTAAAACTGCAACTTTCACGGATGCCAGGATCAGGACCATGAATGAAGTTATAACTGGTA
TAAGGATAATAAAAATGTACGCCTGGGAAAAGTCATTTTCAAATCTTATTACCAATTTGAGAAAGAAGGAGATT
TCCAAGATTCTGAGAAGTTCCTGCCTCAGGGGATGAATTTGGCTTCGTTTTTCAGTGCAAGCAAAATCATCGT
GTTTGTGACCTTCACCACCTACGTGCTCCTCGGCAGTGTGATCACAGCCAGCCGCGTGTTCGTGGCAGTGACGC
TGTATGGGGCTGTGCGGCTGACGGTTACCCTCTTCTTCCCCTCAGCCATTGAGAGGGTGTCAGAGGCAATCGTC
AGCATCCGAAGAATCCAGACCTTTTTGCTACTTGATGAGATATCACAGCGCAACCGTCAGCTGCCGTCAGATGG
TAAAAAGATGGTGCATGTGCAGGATTTTACTGCTTTTTGGGATAAGGCATCAGAGACCCCAACTCTACAAGGCC
TTTCCTTTACTGTCAGACGTGGCGAATTGTTAGCTGTGGTCGGCCCCGTGGGAGCAGGGAAGTCATCACTGTTA
AGTGCCGTGCTCGGGGAATTGGCCCCAAGTCACGGGCTGGTCAGCGTGCATGGAAGAATTGCCTATGTGTCTCA
GCAGCCCTGGGTGTTCTCGGGAACTCTGAGGAGTAATATTTTATTTGGGAAGAAATATGAAAAGGAACGATATG
AAAAAGTCATAAAGGCTTGTGCTCTGAAAAAGGATTTACAGCTGTTGGAGGATGGTGATCTGACTGTGATAGGA
GATCGGGGAACCACGCTGAGTGGAGGGCAGAAAGCACGGGTAAACCTTGCAAGAGCAGTGTATCAAGATGCTGA
CATCTATCTCCTGGACGATCCTCTCAGTGCAGTAGATGCGGAAGTTAGCAGACACTTGTTCGAACTGTGTATTT
GTCAAATTTTGCATGAGAAGATCACAATTTTAGTGACTCATCAGTTGCAGTACCTCAAAGCTGCAAGTCAGATT
CTGATATTGAAAGATGGTAAAATGGTGCAGAAGGGGACTTACACTGAGTTCCTAAAATCTGGTATAGATTTTGG
CTCCCTTTTAAAGAAGGATAATGAGGAAAGTGAACAACCTCCAGTTCCAGGAACTCCCACACTAAGGAATCGTA
CCTTCTCAGAGTCTTCGGTTTGGTCTCAACAATCTTCTAGACCCTCCTTGAAAGATGGTGCTCTGGAGAGCCAA
GATACAGAGAATGTCCCAGTTACACTATCGAGGAGAACCGTTCTGAAGGAAAAGTTGGTTTTCAGGCCTATAA
GAATTACTTCAGAGCTGGTGCTCACTGGATTGTCTTCATTTTCCTTATTCTCCTAAACACTGCAGCTCAGGTTG
CCTATGTGCTTCAAGATTGGTGGCTTTCATACTGGGCAAACAAACAAAGTATGCTAAATGTCACTGTAAATGGA
GGAGGAAATGTAACCGAGAAGCTAGATCTTAACTGGTACTTAGGAATTTATTCAGGTTTAACTGTAGCTACCGT
TCTTTTTGGCATAGCAAGATCTCTATTGGTATTCTACGTCCTTGTTAACTCTTCACAAACTTTGCACAACAAA
TGTTTGAGTCAATTCTGAAAGCTCCGGTATTATTCTTTGATAGAAATCCAATAGGAAGAATTTTAAATCGTTTC
TCCAAAGACATTGGACACTTGGATGATTTGCTGCCGCTGACGTTTTTAGATTTCATCCAGACATTGCTACAAGT
GGTTGGTGTGGTCTCTGTGGCTGTGGCCGTGATTCCTTGGATCGCAATACCCTTGGTTCCCCTTGGAATCATTT
TCATTTTTCTTCGGCGATATTTTTTGGAAACGTCAAGAGATGTGAAGCGCCTGGAATCTACAACTCGGAGTCCA
GTGTTTTCCCACTTGTCATCTTCTCTCCAGGGGCTCTGGACCATCCGGGCATACAAAGCAGAAGAGAGGTGTCA
GGAACTGTTTGATGCACACCAGGATTTACATTCAGAGGCTTGGTTCTTGTTTTTGACAACGTCCCGCTGGTTCG
CCGTCCGTCTGGATGCCATCTGTGCCATGTTTGTCATCATCGTTGCCTTTGGGTCCCTGATTCTGGCAAAAACT
CTGGATGCCGGGCAGGTTGGTTTGGCACTGTCCTATGCCCTCACGCTCATGGGGATGTTTCAGTGGTGTGTTCG
ACAAAGTGCTGAAGTTGAGAATATGATGATCTCAGTAGAAAGGGTCATTGAATACACAGACCTTGAAAAGAAG
CACCTTGGGAATATCAGAAACGCCCACCACCAGCCTGGCCCCATGAAGGAGTGATAATCTTTGACAATGTGAAC
TTCATGTACAGTCCAGGTGGGCCTCTGGTACTGAAGCATCTGACAGCACTCATTAAATCACAAGAAAAGGTTGG
CATTGTGGGAAGAACCGGAGCTGGAAAAAGTTCCCTCATCTCAGCCCTTTTAGATTGTCAGAACCCGAAGGTA
AAATTTGGATTGATAAGATCTTGACAACTGAAATTGGACTTCACGATTTAAGGAAGAAAATGTCAATCATACCT
CAGGAACCTGTTTTGTTCACTGGAACAATGAGGAAAAACCTGGATCCCTTTAAGGAGCACACGGATGAGGAACT
GTGGAATGCCTTACAAGAGGTACAACTTAAAGAAACCATTGAAGATCTTCCTGGTAAAATGGATACTGAATTAG
CAGAATCAGGATCCAATTTTAGTGTTGGACAAAGACAACTGGTGTGCCTTGCCAGGGCAATTCTCAGGAAAAAT
CAGATATTGATTATTGATGAAGCGACGGCAAATGTGGATCCAAGAACTGATGAGTTAATACAAAAAAAAATCCG
GGAGAAATTTGCCCACTGCACCGTGCTAACCATTGCACACAGATTGAACACCATTATTGACAGCGACAAGATAA
TGGTTTTAGATTCAGGAAGACTGAAAGAATATGATGAGCCGTATGTTTTGCTGCAAAATAAAGAGAGCCTATTT
TACAAGATGGTGCAACAACTGGGCAAGGCAGAAGCCGCTGCCCTCACTGAAACAGCAAAACAGGTATACTTCAA
AAGAAATTATCCACATATTGGTCACACTGACCACATGGTTACAAACACTTCCAATGGACAGCCCTCGACCTTAA
CTATTTTCGAGACAGCACTGTGAATCCAACCAAAATGTCAAGTCCGTTCCGAAGGCATTTTCCACTAGTTTTTG
GACTATGTAAACCACATTGTACTTTTTTTTACTTTGGCAACAAATATTTATACATACAAGATGCTAGTTCATTT
GAATATTTCTCCC
```

FIGURE 50

```
CTCCGTCCCAGGGGAGAAGGAGAGGCGTCTGCAGGGGGCAGAGACCGCAGCTACCTGCCGGGTGCGCCCCCAC
CCAGGAGCGCTCGCTTCGCCCCCTTTCCTCCCCCCGCCCCACCTCCTTATTGGTGCTAGTTTGCAGCGCCCAG
CTCCTGCGCCTTCGCTTCGCGTTTGAATCTGGCTCGCCCCTTCGTATTATGTCTGCACTCCGAAGGAAATTTGG
GGACGATTATCAGGTAGTGACCACATCGTCCAGCGGCTCGGGCTTGCAGCCCCAGGGGCCAGGCCAGGACCCTC
AGCAGCAGCTTGTGCCCAAGAAGAAGCGGCAGCGGTTCGTGGACAAGAACGGCCGGTGCAATGTACAGCACGGC
AACCTGGGCAGCGAGACAAGCCGCTACCTCTCGGACCTCTTCACCACGCTGGTGGACCTCAAGTGGCGCTGGAA
CCTCTTCATCTTCATTCTCACCTACACCGTGGCCTGGCTTTTCATGGCGTCCATGTGGTGGGTGATCGCCTACA
CTCGGGGCGACCTGAACAAAGCCCACGTCGGTAACTACACGCCTTGCGTGGCCAATGTCTATAACTTCCCTTCT
GCCTTCCTCTTCTTCATCGAGACGGAGGCCACCATCGGCTATGGCTACCGATACATCACAGACAAGTGCCCCGA
GGGCATCATCCTCTTCCTCTTCCAGTCCATCCTGGGCTCCATCGTGGACGCCTTCCTCATCGGCTGCATGTTCA
TCAAGATGTCCCAGCCCAAGAAGCGCGCCGAGACCCTCATGTTCAGCGAGCACGCGGTGATCTCCATGAGGGAC
GGAAAACTCACGCTTATGTTCCGGGTGGGCAACCTGCGCAACAGCCACATGGTCTCCGCGCAGATTCGCTGCAA
GCTGCTCAAATCTCGGCAGACACCTGAGGGTGAGTTCCTTCCCCTTGACCAACTTGAACTGGATGTAGGTTTTA
GTACAGGGGCAGATCAACTTTTTCTTGTGTCCCCCCTCACAATTTGCCACGTGATCGATGCCAAAAGCCCCTTT
TATGACCTATCCCAGCGAAGCATGCAAACTGAACAGTTCGAGATTGTCGTCATCCTAGAAGGCATTGTGGAAAC
AACTGGGATGACTTGTCAAGCTCGAACATCATATACTGAAGATGAAGTTCTTTGGGGTCATCGTTTTTTTCCTG
TAATTTCCTTAGAAGAGGGATTCTTTAAAGTTGATTACTCCCAGTTCCACGCAACATTTGAAGTCCCCACCCCA
CCTTACAGTGTGAAAGAGCAGGAGGAAATGCTTCTCATGTCGTCCCCTTTAATAGCACCAGCCATAACTAACAG
CAAAGAAAGACATAATTCTGTGGAATGCTTAGATGGACTAGATGATATTACTACAAAACTACCATCTAAGCTGC
AGAAAATTACTGGAAGAGAAGACTTTCCCAAAAAACTCTTGAGGATGAGTTCTACAACTTCAGAAAAAGCCTAC
AGCTTGGGAGACTTGCCCATGAAACTTCAACGAATAAGTTCAGTTCCGGGCAACTCAGAAGAAAACTGGTATC
TAAAACCACCAAGATGTTATCTGATCCCATGAGCCAGTCTGTGGCTGATTTGCCACCAAAGCTTCAAAAGATGG
CTGGAGGAGCAGCTAGGATGGAAGGGAACCTTCCAGCCAAATTAAGAAAAATGAACTCTGATCGCTTCACATAA
CAAAGCACTCCCTTAGGCATTATTTAATGTTTGATTTAGTAATAGTCCAATATTTGGCGATGAGGTAATTCTCC
CTAAGGAATCTGAAAGTATATTTTCCTCCCAGTTCTACAGCATATTTCGAGAACCCTTCCTTTCCCAAGTATTG
CGAATGTGCAGAAAGCAACAGTTACGGAGGGAGGACATCATAAGGAAGTTATTAACGGGCATGTATTATCACAT
CAAGCATGCAATAATGTGCAAATTTTGCATTTAGTTTTATGGCATGATTTATATATGGCATATTTATATTGTAT
ATTCTGGAAAAAAAATATATATATATATTTAAAGGGGAGATACTCTCCCTGACATTTCTAACATATGTATTAA
GCCAAACATGAGTGAATAGCTTTCAGGGCGATAAAACTAAATATATGTCTGTGTGTGTGTGTATGTATACAC
ACATATACATATATATACACATACATACACATACATACATACATACATATATATCTGATAAAATTGTGATGT
TTTGTTCAAAGTTGTAGTTCTTGTGCATGTTTACTTTATTAGAGTAGGAAGGCTACTGGCATTAATTATTAATA
CCAAATATTTTAGCCTTAAATTTTTGTCATTTTAAAATCTGATTTAATGTTTTCTGCTGTTTAAGGTCTTGGGA
GGCTTTCAATTGTATTTTATATGAGAGAATCACACAAGTTTGTGCTATCTATGGCCCTGCAAAAATATAACCAT
TACATGTTTAAATTGTAAATTTTAGAGCATACCAGTACTCAGTATAGCATTGAACATTTCTTATGATTTTAAA
AGTTGCTAGTACTGGGGAGAAATAATTGTTGATTAATTTGAGAATTATTCCTTTCCTAGACTAATTAAAATCTG
GAAATCTGTTTTGTATATGATCTAATACAAAGATGAGCTCTGAACAAACACTGAATCATGTTAATAGACAGTAG
CCAAGTTATATTGAATATATCAGAATCTGTGTGAAGTTACACAATTAATTGTCCCTGTTTCAAACTGAGTAAAT
TGGAAACATTTTCTTTCTTTTTCTGGAAATTTTGTCCATTTTAAAAACCAATCATTTTAAGAAGACATGACAAT
GCAATGAAACAGATGATAAATATTTATGCTTAAAATAAAAAAAAAAAAA
```

FIGURE 51

```
GAGAGGGTCCTTCAGGGTCTGCTTATGCCCTTGTTCAAGAACACCAGTGTCAGCTCTCTGTACTCTGGTTGCAG
ACTGACCTTGCTCAGGCCTGAGAAGGATGGGGCAGCCACCAGAGTGGATGCTGTCTGCACCCATCGTCCTGACC
CCAAAAGCCCTGGACTGGACAGAGAGCGGCTGTACTGGAAGCTGAGCCAGCTGACCCACGGCATCACTGAGCTG
GGCCCCTACACCCTGGACAGGCACAGTCTCTATGTCAATGGTTTCACCCATCAGAGCTCTATGACGACCACCAG
AACTCCTGATACCTCCACAATGCACCTGGCAACCTCGAGAACTCCAGCCTCCCTGTCTGGACCTACGACCGCCA
GCCCTCTCCTGGTGCTATTCACAATTAACTTCACCATCACTAACCTGCGGTATGAGGAGAACATGCATCACCCT
GGCTCTAGAAAGTTTAACACCACGGAGAGAGTCCTTCAGGGTCTGCTCAGGCCTGTGTTCAAGAACACCAGTGT
TGGCCCTCTGTACTCTGGCTGCAGACTGACCTTGCTCAGGCCCAAGAAGGATGGGGCAGCCACCAAAGTGGATG
CCATCTGCACCTACCGCCCTGATCCCAAAAGCCCTGGACTGGACAGAGAGCAGCTATACTGGGAGCTGAGCCAG
CTAACCCACAGCATCACTGAGCTGGGCCCCTACACCCTGGACAGGGACAGTCTCTATGTCAATGGTTTCACACA
GCGGAGCTCTGTGCCCACCACTAGCATTCCTGGGACCCCACAGTGGACCTGGGAACATCTGGGACTCCAGTTT
CTAAACCTGGTCCCTCGGCTGCCAGCCCTCTCCTGGTGCTATTCACTCTCAACTTCACCATCACCAACCTGCGG
TATGAGGAGAACATGCAGCACCCTGGCTCCAGGAAGTTCAACACCACGGAGAGGGTCCTTCAGGGCCTGCTCAG
GTCCCTGTTCAAGAGCACCAGTGTTGGCCCTCTGTACTCTGGCTGCAGACTGACTTTGCTCAGGCCTGAAAAGG
ATGGGACAGCCACTGGAGTGGATGCCATCTGCACCCACCACCCTGACCCCAAAAGCCCTAGGCTGGACAGAGAG
CAGCTGTATTGGGAGCTGAGCCAGCTGACCCACAATATCACTGAGCTGGGCCACTATGCCCTGGACAACGACAG
CCTCTTTGTCAATGGTTTCACTCATCGGAGCTCTGTGTCCACCACCAGCACTCCTGGGACCCCACAGTGTATC
TGGGAGCATCTAAGACTCCAGCCTCGATATTTGGCCCTTCAGCTGCCAGCCATCTCCTGATACTATTCACCCTC
AACTTCACCATCACTAACCTGCGGTATGAGGAGAACATGTGGCCTGGCTCCAGGAAGTTCAACACTACAGAGAG
GGTCCTTCAGGGCCTGCTAAGGCCCTTGTTCAAGAACACCAGTGTTGGCCCTCTGTACTCTGGCTCCAGGCTGA
CCTTGCTCAGGCCAGAGAAAGATGGGGAAGCCACCGGAGTGGATGCCATCTGCACCCACCGCCCTGACCCCACA
GGCCCTGGGCTGGACAGAGAGCAGCTGTATTTGGAGCTGAGCCAGCTGACCCACAGCATCACTGAGCTGGGCCC
CTACACACTGGACAGGGACAGTCTCTATGTCAATGGTTTCACCCATCGGAGCTCTGTACCCACCACCAGCACCG
GGGTGGTCAGCGAGGAGCCATTCACACTGAACTTCACCATCAACAACCTGCGCTACATGCGGACATGGGCCAA
CCCGGCTCCCTCAAGTTCAACATCACAGACAACGTCATGGCACCTGCTCAGTCCTTTGTTCCAGAGGAGCAG
CCTGGGTGCACGGTACACAGGCTGCAGGGTCATCGCACTAAGGTCTGTGAAGAACGGTGCTGAGACACGGGTGG
ACCTCCTCTGCACCTACCTGCAGCCCCTCAGCGGCCCAGGTCTGCCTATCAAGCAGGTGTTCCATGAGCTGAGC
CAGCAGACCCATGGCATCACCCGGCTGGGCCCCTACTCTCTGGACAAAGACAGCCTCTACCTTAACGGTTACAA
TGAACCTGGTCTAGATGAGCCTCCTACAACTCCCAAGCCAGCCACCACATTCCTGCCTCCTCTGTCAGAAGCCA
CAACAGCCATGGGGTACCACCTGAAGACCCTCACACTCAACTTCACCATCTCCAATCTCCAGTATTCACCAGAT
ATGGGCAAGGGCTCAGCTACATTCAACTCCACCGAGGGGGTCCTTCAGCACCTGCTCAGACCCTTGTTCCAGAA
GAGCAGCATGGGCCCCTTCTACTTGGGTTGCCAACTGATCTCCCTCAGGCCTGAGAAGGATGGGGCAGCCACTG
GTGTGGACACCACCTGCACCTACCACCCTGACCCTGTGGGCCCCGGGCTGGACATACAGCAGCTTTACTGGGAG
CTGAGTCAGCTGACCCATGGTGTCACCCAACTGGGCTTCTATGTCCTGGACAGGGATAGCCTCTTCATCAATGG
CTATGCACCCCAGAATTTATCAATCCGGGGCGAGTACCAGATAAATTTCCACATTGTCAACTGGAACCTCAGTA
ATCCAGACCCCACATCCTCAGAGTACATCACCCCTGCTGAGGGACATCCAGGACAAGGTCACCACACTCTACAA
GGCAGTCAACTACATGACACATTCCGCTTCTGCCTGGTCACCAACTTGACGATGGACTCCGTGTTGGTCACTGT
CAAGGCATTGTTCTCCAATTTGGACCCCAGCCTGGTGGAGCAAGTCTTTCTAGATAAGACCCTGAATGCCT
CATTCCATTGGCTGGGCTCCACCTACCAGTTGGTGGACATCCATGTGACAGAAATGGAGTCATCAGTTTATCAA
CCAACAAGCAGCTCCAGCACCCAGCACTTCTACCCGAATTTCACCATCACCAACCTACCATATTCCCAGGACAA
AGCCCAGCCAGGCACCACCAATTACCAGAGGAACAAAAGGAATATTGAGGATGCGCTCAACCAACTCTTCCGAA
ACAGCAGCATCAAGAGTTATTTTCTGACTGTCAAGTTTCAACATTCAGGTCTGTCCCCAACAGGCACCACACC
GGGGTGGACTCCCTGTGTAACTTCTCGCCACTGGCTCGGAGAGTAGACAGAGTTGCCATCTATGAGGAATTTCT
GCGGATGACCCGGAATGGTACCCAGCTGCAGAACTTCACCCTGGACAGGAGCAGTGTCCTTGTGGATGGGTATT
CTCCCAACAGAAATGAGCCCTTAACTGGGAATTCTGACCTTCCCTTCTGGGCTGTCATCTTCATCGGCTTGGCA
GGACTCCTGGGACTCATCACATGCCTGATCTGCGGTGTCCTGGTGACCACCCGCCGGCGGAAGAAGGAAGGAGA
ATACAACGTCCAGCAACAGTGCCCAGGCTACTACCAGTCACACCTAGACCTGGAGGATCTGCAATGACTGGAAC
TTGCCGGTGCCTGGGGTGCCTTTCCCCCAGCCAGGGTCCAAAGAAGCTTGGCTGGGCAGAAATAAACCATATT
GGTCG
```

FIGURE 52

```
GCCCGGGCAGGTGCTGATAGCACAGTTCTGTCCAGAGAAGGAAGGCGGAATAAACTTATTCATTCCCAGGAACT
CTTGGGGTAGGTGTGTGTTTTTCACATCTTAAAGGCTCACAGACCCTGCGCTGGACAAATGTTCCATTCCTGAA
GGACCTCTCCAGAATCCGGATTGCTGAATCTTCCCTGTTGCCTAGAAGGGCTCCAAACCACCTCTTGACAATGG
GAAACTGGGTGGTTAACCACTGGTTTTCAGTTTTGTTTCTGGTTGTTTGGTTAGGGCTGAATGTTTCCTGTTT
GTGGATGCCTTCCTGAAATATGAGAAGGCCGACAAATACTACTACACAAGAAAAATCCTTGGGTCAACATTGGC
CTGTGCCCGAGCGTCTGCTCTCTGCTTGAATTTTAACAGCACGCTGATCCTGCTTCCTGTGTGTGTCGCAATCTGC
TGTCCTTCCTGAGGGGCACCTGCTCATTTTGCAGCCGCACACTGAGAAAGCAATTGGATCACAACCTCACCTTC
CACAAGCTGGTGGCCTATATGATCTGCCTACATACAGCTATTCACATCATTGCACACCTGTTTAACTTTGACTG
CTATAGCAGAAGCCGACAGGCCACAGATGGCTCCCTTGCCTCCATTCTCTCCAGCCTATCTCATGATGAGAAAA
AGGGGGGTTCTTGGCTAAATCCCATCCAGTCCCGAAACACGACAGTGGAGTATGTGACATTCACCAGCGTTGCT
GGTCTCACTGGAGTGATCATGACAATAGCCTTGATTCTCATGGTAACTTCAGCTACTGAGTTCATCCGGAGGAG
TTATTTTGAAGTCTTCTGGTATACTCACCACCTTTTATCTTCTATATCCTTGGCTTAGGGATTCACGGCATTG
GTGGAATTGTCCGGGGTCAAACAGAGGAGAGCATGAATGAGAGTCATCCTCGCAAGTGTGCAGAGTCTTTTGAG
ATGTGGGATGATCGTGACTCCCACTGTAGGCGCCCTAAGTTTGAAGGGCATCCCCCTGAGTCTTGGAAGTGGAT
CCTTGCACCGGTCATTCTTTATATCTGTGAAAGGATCCTCCGGTTTTACCGCTCCCAGCAGAAGGTTGTGATTA
CCAAGGTTGTTATGCACCCATCCAAAGTTTTGGAATTGCAGATGAACAAGCGTGGCTTCAGCATGGAAGTGGGG
CAGTATATCTTTGTTAATTGCCCCTCAATCTCTCCTGGAATGGCATCCTTTTACTTTGACCTCTGCTCCAGA
GGAAGATTTCTTCTCCATTCATATCCGAGCAGCAGGGGACTGGACAGAAAATCTCATAAGGGCTTTCGAACAAC
AATATTCACCAATTCCCAGGATTGAAGTGGATGGTCCCTTTGGCACAGCCAGTGAGGATGTTTTCCAGTATGAA
GTGGCTGTGCTGGTTGGAGCAGGAATTGGGGTCACCCCCTTTGCTTCTATCTTGAAATCCATCTGGTACAAATT
CCAGTGTGCAGACCACAACCTCAAAACAAAAAAGATCTATTTCTACTGGATCTGCAGGGAGACAGGTGCCTTTT
CCTGGTTCAACAACCTGTTGACTTCCCTGGAACAGGAGATGGAGGAATTAGGCAAAGTGGGTTTTCTAAACTAC
CGTCTCTTCCTCACCGGATGGGACAGCAATATTGTTGGTCATGCAGCATTAAACTTTGACAAGGCCACTGACAT
CGTGACAGGTCTGAAACAGAAAACCTCCTTTGGGAGACCAATGTGGGACAATGAGTTTTCTACAATAGCTACCT
CCCACCCCAAGTCTGTAGTGGGAGTTTTCTTATGTGGCCCTCGGACTTTGGCAAAGAGCCTGCGCAAATGCTGT
CACCGATATTCCAGTCTGGATCCTAGAAAGGTTCAATTCTACTTCAACAAAGAAAATTTTTGAGTTATAGGAAT
AAGGACGGTAATCTGCATTTTGTCTCTTTGTATCTTCAGTAATTGAGTTATAGGAATAAGGACGGTAATCTGCA
TTTTGTCTCTTTGTATCTTCAGTAATTTACTTGGTCTCGTCAGGTTTGAGCAGTCACTTTAGGATAAGAATGTG
CCTCTCAAGCCTTGACTCCCTGGTATTCTTTTTTTGATTGCATTCAACTTCGTTACTTGAGCTTCAGCAACTTA
AGAACTTCTGAAGTTCTTAAAGTTCTGAAGTTCTTAAAGCCCATGGATCCTTTCTCAGAAAATAACTGTAAAT
CTTTCTGGACAGCCATGACTGTAGCAAGGCTTGATAGCAGAGGTTTGGTGGTTCAGAGTTATACAACTAATCCC
AGGTGATTTATCAATTCCAGTGTTACCATCTCCTGAGTTTTGGTTTGTAATCTTTTGTCCCTCCCACCCCCAC
AGAAGATTTCTAAGTAGGGTGACTTTTTAAATAAAAATTTATTGAATAATTAATGATAAAACATAATAATAAAC
ATAAATAATAAACAAAATTACCGAGAACCCCATCCCCATATAACACCAACAGTGTACATGTTTACTGTCACTTT
TGATATGGTCTTATCCAGTGTGAACAGCAATTTATTATTTTGCTCATCAAAAAATAAAGGATTTTCTTCTTCA
CTTGATGAATGAGTCTTTTGTTACTTCTTTTTGGGCTCTCCATTTGGGAAAGAAAATCTAGAAAGTATGCTCAT
TGTAATTGAAATTGTATTATAATTGCAAGTCAGCTATACTGTCATCTTGTATTATTCTGTTAAAAGCGATTGTG
AAAACTTGAACTCCATGTTAGGATGACTTATTTAGTCAAGAGGAGCTCTTTATCACTATTAAGGGAGTTTATTA
ATGTCTAGTTTAAAAAATAACAATTTATAATTTTCATAGATTTTTGTGGACTCCTACCTATATCGCTAAGGAAT
CATTCAGCTAATAACATAAGCAAAATGCCTTCATTCTCTATCAGAATGCTTTTTATTTCTGCCATCTACCCAAC
CTCGGCCTACAAGGACCACACTGGCTCTGGGATGTTAGTCGTCACAGTGAATCCCTAGAAGGAGAGAAGCCCAG
GGCTCTTAAGAGAGAAACCTCACACTTCATTGTGCCCAGACAATTCAACTCATTATAGATTAGAAGAATGGTTG
TACTGAATTAGCATTATATTATCTATTTTTCTACCATTAAGTGACCACGAATGAACAAATGGTTGTTTCTAAT
AGTTTAGGAACCTCTACGGCTTGAGGGATAAAACTGTTTTTGGTTTTTTTTTGTCACTAGTCTGAGCACAATAA
AGGTAGGTCATGAACTCATGGTGGCTAATCATGTTTCATTTATTACAACAGTAAAACAATACTGATGGTTGTTT
ACATAGGGAGGGATACCACTGCTGTTGCCAATTTGTTCACCCGGATTTCAGCTAATTCAGGTTTAATAAGGCTT
TGGGAAAATGCACAATGAAACCTTGAAGACATGATTCTTATTAGACAACTACTGACCAAATGACAACTTCATCT
TCAATGACCTTGATTTGGAATCTTGAAACTTACAACGAGTTCCTAATGAGAAAGGCATCACTCTTGGTCTCCAT
GTCTAAATATATTGACACACTCACTTCAAGATATGATGGCTGCCAAAATCAATATCCCAAGGCTTGAATATTTA
TGGGAGTAGGCATAAATTCGTGATTATATTCATGGTAATGAATATAATAAATCCTATGCATAGCCAACATCCAA
GTTGAACTGGGGATGAGCAGGATACACAGAAAGCTCCTCACCTGCTTTGAGCAAGTTTTTCTTGCAAAGTTGTA
ATATGAAATACCTTAATCAACAAATTTCTTATAAATGTTTATATGAGTAGAAAATCCCTCAATTTCATTGTCAC
TCAAAAAGTTGATTATCT
```

FIGURE 53

CCCTTGGGCTCCAAACCACCTCTTGACAATGGGAAACTGGGTGGTTAACCACTGGTTTTCAGTTTTGTTTCTGG
TTGTTTGGTTAGGGCTGAATGTTTTCCTGTTTGTGGATGCCTTCCTGAAATATGAGAAGGCCGACAAATACTAC
TACACAAGAAAAATCCTTGGGTCAACATTGGCCTGTGCCCGAGCGTCTGCTCTCTGCTTGAATTTTAACAGCAC
GCTGATCCTGCTTCCTGTGTGTCGCAATCTGCTGTCCTTCCTGAGGGGCACCTGCTCATTTTGCAGCCGCACAC
TGAGAAAGCAATTGGATCACAACCTCACCTTCCACAAGCTGGTGGCCTATATGATCTGCCTACATACAGCTATT
CACATCATTGCACACCTGTTTAACTTTGACTGCTATAGCAGAAGCCGACAGGCCACAGATGGCTCCCTTGCCTC
CATTCTCTCCAGCCTATCTCATGATGAGAAAAAGGGGGGTTCTTGGCTAAATCCCATCCAGTCCCGAAACACGA
CAGTGGAGTATGTGACATTCACCAGCATTGCTGGTCTCACTGGAGTGATCATGACAATAGCCTTGATTCTCATG
GTAACTTCAGCTACTGAGTTCATCCGGAGGAGTTATTTTGAAGTCTTCTGGTATACTCACCACCTTTTTATCTT
CTATATCCTTGGCTTAGGGATTCACGGCATTGGTGGAATTGTCCGGGGTCAAACAGAGGAGAGCATGAATGAGA
GTCATCCTCGCAAGTGTGCAGAGTCTTTTGAGATGTGGGATGATCGTGACTCCCACTGTAGGCGCCCTAAGTTT
GAAGGGCATCCCCCTGAGTCTTGGAAGTGGATCCTTGCACCGGTCATTCTTTATATCTGTGAAAGGATCCTCCG
GTTTTACCGCTCCCAGCAGAAGGTTGTGATTACCAAGGTTGTTATGCACCCATCCAAAGTTTTGGAATTGCAGA
TGAACAAGCGTGGCTTCAGCATGGAAGTGGGGCAGTATATCTTTGTTAATTGCCCCTCAATCTCTCTCCTGGAA
TGGCATCCTTTTACTTTGACCTCTGCTCCAGAGGAAGATTTCTTCTCCATTCATATCCGAGCAGCAGGGGACTG
GACAGAAAATCTCATAAGGGCTTTCGAACAACAATATTCACCAATTCCCAGGATTGAAGTGGATGGTCCCTTTG
GCACAGCCAGTGAGGATGTTTTCCAGTATGAAGTGGCTGTGCTGGTTGGAGCAGGAATTGGGGTCACCCCCTTT
GCTTCTATCTTGAAATCCATCTGGTACAAATTCCAGTGTGCAGACCACAACCTCAAAACAAAAAGATCTATTT
CTACTGGATCTGCAGGGAGACAGGTGCCTTTTCCTGGTTCAACAACCTGTTGACTTCCCTGGAACAGGAGATGG
AGGAATTAGGCAAAGTGGGTTTTCTAAACTACCGTCTCTTCCTCACCGGATGGGACAGCAATATTGTTGGTCAT
GCAGCATTAAACTTTGACAAGGCCACTGACATCGTGACAGGTCTGAAACAGAAAACCTCCTTTGGGAGACCAAT
GTGGGACAATGAGTTTTCTACAATAGCTACCTCCCACCCCAAGTCTGTAGTGGGAGTTTTCTTATGTGGCCCTC
GGACTTTGGCAAAGAGCCTGCGCAAATGCTGTCACCGATATTCCAGTCTGGATCCTAGAAAGGTTCAATTCTAC
TTCAACAAAGAAAATTTTTGAGTTATAGGAATAAGGACGGTAATCTGCATTTTGTCTCTTTGTATCTTCAGTAA
TTTACTTGGTCTCGTCAGGTTTGAGCAGTCACTTTAGGAAG

FIGURE 54

GGGCTCCAAACCACCTCTTGACAATGGGAAACTGGGTGGTTAACCACTGGTTTTCAGTTTTGTTTCTGGTTGTT
TGGTTAGGGCTGAATGTTTTCCTGTTTGTGGATGCCTTCCTGAAATATGAGAAGGCCGACAAATACTACTACAC
AAGAAAAATCCTTGGGTCTTGGAAGTGGATCCTTGCACCGGTCATTCTTTATATCTGTGAAAGGATCCTCCGGT
TTTACCGCTCCCAGCAGAAGGTTGTGATTACCAAGGTTGTTATGCACCCATCCAAAGTTTTGGAATTGCAGATG
AACAAGCGTGGCTTCAGCATGGAAGTGGGGCAGTATATCTTTGTTAATTGCCCCTCAATCTCTCTCCTGGAATG
GCATCCTTTTACTTTGACCTCTGCTCCAGAGGAAGATTTCTTCTCCATTCATATCCGAGCAGCAGGGGACTGGA
CAGAAAATCTCATAAGGGCTTTCGAACAACAATATTCACCAATTCCCAGGATTGAAGTGGATGGTCCCTTTGGC
ACAGCCAGTGAGGATGTTTTCCAGTATGAAGTGGCTGTGCTGGTTGGAGCAGGAATTGGGGTCACCCCCTTTGC
TTCTATCTTGAAATCCATCTGGTACAAATTCCAGTGTGCAGACCACAACCTCAAAACAAAAAAGGTTGGTCATG
CAGCATTAAACTTTGACAAGGCCACTGACATCGTGACAGGTCTGAAACAGAAAACCTCCTTTGGGAGACCAATG
TGGGACAATGAGTTTTCTACAATAGCTACCTCCCACCCCAAGTCTGTAGTGGGAGTTTTCTTATGTGGCCCTCG
GACTTTGGCAAAGAGCCTGCGCAAATGCTGTCACCGATATTCCAGTCTGGATCCTAGAAAGGTTCAATTCTACT
TCAACAAAGAAAATTTTTGAGTTATAGGAATAAGGACGGTAATCTGCATTTTGTCTCTTTGTATCTTCAGTAAT
TTACTTGGTCTCGTCAGGTTTGAGCAGTCACTTTAGGA

FIGURE 55

GGGCTCCAAACCACCTCTTGACAATGGGAAACTGGGTGGTTAACCACTGGTTTTCAGTTTTGTTTCTGGTTGTT
TGGTTAGGGCTGAATGTTTTCCTGTTTGTGGATGCCTTCCTGAAATATGAGAAGGCCGACAAATACTACAC
AAGAAAAATCCTTGGGTCAACATTGGCCTGTGCCCGAGCGTCTGCTCTCTGCTTGAATTTTAACAGCACGCTGA
TCCTGCTTCCTGTGTGTCGCAATCTGCTGTCCTTCCTGAGGGGCACCTGCTCATTTTGCAGCCGCACACTGAGA
AAGCAATTGGATCACAACCTCACCTTCCACAAGCTGGTGGCCTATATGATCTGCCTACATACAGCTATTCACAT
CATTGCACACCTGTTTAACTTTGACTGCTATAGCAGAAGCCGACAGGCCACAGATGGCTCCCTTGCCTCCATTC
TCTCCAGCCTATCTCATGATGAGAAAAAGGGGGGTTCTTGGCTAAATCCCATCCAGTCCCGAAACACGACAGTG
GAGTATGTGACATTCACCAGCATTGCTGGTCTCACTGGAGTGATCATGACAATAGCCTTGATTCTCATGGTAAC
TTCAGCTACTGAGTTCATCCGGAGGAGTTATTTTGAAGTCTTCTGGTATACTCACCACCTTTTTATCTTCTATA
TCCTTGGCTTAGGGATTCACGGCATTGGTGGAATTGTCCGGGGTCAAACAGAGGAGAGCATGAATGAGAGTCAT
CCTCGCAAGTGTGCAGAGTCTTTTGAGATGTGGGATGATCGTGACTCCCACTGTAGGCGCCCTAAGTTTGAAGG
GCATCCCCCTGAGTCTTGGAAGTGGATCCTTGCACCGGTCATTCTTTATATCTGTGAAAGGATCCTCCGGTTTT
ACCGCTCCCAGCAGAAGGTTGTGATTACCAAGGTTGTTATGCACCCATCCAAAGTTTTGGAATTGCAGATGAAC
AAGCGTGGCTTCAGCATGGAAGTGGGGCAGTATATCTTTGTTAATTGCCCCTCAATCTCTCTCCTGGAATGGCA
TCCTTTTACTTTGACCTCTGCTCCAGAGGAAGATTTCTTCTCCATTCATATCCGAGCAGCAGGGGACTGGACAG
AAAATCTCATAAGGGCTTTCGAACAACAATATTCACCAATTCCCAGGATTGAAGTGGATGGTCCCTTTGGCACA
GCCAGTGAGGATGTTTTCCAGTATGAAGTGGCTGTGCTGGTTGGAGCAGGAATTGGGGTCACCCCCTTTGCTTC
TATCTTGAAATCCATCTGGTACAAATTCCAGTGTGCAGACCACAACCTCAAAACAAAAAAGGTTGGTCATGCAG
CATTAAACTTTGACAAGGCCACTGACATCGTGACAGGTCTGAAACAGAAAACCTCCTTTGGGAGACCAATGTGG
GACAATGAGTTTTCTACAATAGCTACCTCCCACCCCAAGTCTGTAGTGGGAGTTTTCTTATGTGGCCCTCGGAC
TTTGGCAAAGAGCCTGCGCAAATGCTGTCACCGATATTCCAGTCTGGATCCTAGAAAGGTTCAATTCTACTTCA
ACAAAGAAAATTTTTGAGTTATAGGAATAAGGACGGTAATCTGCATTTTGTCTCTTTGTATCTTCAGTAATTTA
CTTGGTCTCGTCAGGTTTGAGCAGTCACTTTAGGAAG

FIGURE 56

```
GGACTGCTTTGTAACTGCTAAGATTGCAGACAGAAATAGCACACAACCACTGTGAGCTGTATGCGATTCAGAAA
CCAAGACCAAATTTTGCTCACTTTCATTAATCAGTTGCTCAGATAGAAGGAAATGACATCTGGTTCTGTCTTCT
TCTACATCTTAATTTTTGGAAAATATTTTTCTCATGGGGGTGGACAGGATGTCAAGTGCTCCCTTGGCTATTTC
CCCTGTGGGAACATCACAAAGTGCTTGCCTCAGCTCCTGCACTGTAACGGTGTGGACGACTGCGGGAATCAGGC
CGATGAGGACAACTGTGGAGACAACAATGGATGGTCCATGCAATTTGACAAATATTTTGCCAGTTACTACAAAA
TGACTTCCCAATATCCTTTTGAGGCAGAAACACCTGAATGTTTGGTCGGTTCTGTGCCAGTGCAATGTCTTTGC
CAAGGTCTGGAGCTTGACTGTGATGAAACCAATTTACGAGCTGTTCCATCGGTTTCTTCAAATGTGACTGCAAT
GTCACTTCAGTGGAACTTAATAAGAAAGCTTCCTCCTGATTGCTTCAAGAATTATCATGATCTTCAGAAGCTGT
ACCTGCAAAACAATAAGATTACATCCATCTCCATCTATGCTTTCAGAGGACTGAATAGCCTTACTAAACTGTAT
CTCAGTCATAACAGAATAACCTTCCTGAAGCCGGGTGTTTTTGAAGATCTTCACAGACTAGAATGGCTGATAAT
TGAAGATAATCACCTCAGTCGAATTTCCCCACCAACATTTTATGGACTAAATTCTCTTATTCTCTTAGTCCTGA
TGAATAACGTCCTCACCCGTTTACCTGATAAACCTCTCTGTCAACACATGCCAAGACTACATTGGCTGGACCTT
GAAGGCAACCATATCCATAATTTAAGAAATTTGACTTTTATTTCCTGCAGTAATTTAACTGTTTTAGTGATGAG
GAAAAACAAAATTAATCACTTAAATGAAAATACTTTTGCACCTCTCCAGAAACTGGATGAATTGGATTTAGGAA
GTAATAAGATTGAAAATCTTCCACCGCTTATATTCAAGGACCTGAAGGAGCTGTCACAATTGAATCTTTCCTAT
AATCCAATCCAGAAAATTCAAGCAAACCAATTTGATTATCTTGTCAAACTCAAGTCTCTCAGCCTAGAAGGGAT
TGAAATTTCAAATATCCAACAAAGGATGTTTAGACCTCTTATGAATCTCTCTCACATATATTTTAAGAAATTCC
AGTACTGTGGGTATGCACCACATGTTCGCAGCTGTAAACCAAACACTGATGGAATTTCATCTCTAGAGAATCTC
TTGGCAAGCATTATTCAGAGAGTATTTGTCTGGGTTGTATCTGCAGTTACCTGCTTTGGAAACATTTTTGTCAT
TTGCATGCGACCTTATATCAGGTCTGAGAACAAGCTGTATGCCATGTCAATCATTTCTCTCTGCTGTGCCGACT
GCTTAATGGGAATATATTTATTCGTGATCGGAGGCTTTGACCTAAAGTTTCGTGGAGAATACAATAAGCATGCG
CAGCTGTGGATGGAGAGTACTCATTGTCAGCTTGTAGGATCTTTGGCCATTCTGTCCACAGAAGTATCAGTTTT
ACTGTTAACATTTCTGACATTGGAAAAATACATCTGCATTGTCTATCCTTTTAGATGTGTGAGACCTGGAAAAT
GCAGAACAATTACAGTTCTGATTCTCATTTGGATTACTGGTTTTATAGTGGCTTTCATTCCATTGAGCAATAAG
GAATTTTTCAAAAACTACTATGGCACCAATGGAGTATGCTTCCCTCTTCATTCAGAAGATACAGAAAGTATTGG
AGCCCAGATTTATTCAGTGGCAATTTTTCTTGGTATTAATTTGGCCGCATTTATCATCATAGTTTTTTCCTATG
GAAGCATGTTTTATAGTGTTCATCAAAGTGCCATAACAGCAACTGAAATACGGAATCAAGTTAAAAAAGAGATG
ATCCTTGCCAAACGTTTTTTCTTTATAGTATTTACTGATGCATTATGCTGGATACCCATTTTTGTAGTGAAATT
TCTTTCACTGCTTCAGGTAGAAATACCAGGTACCATAACCTCTTGGGTAGTGATTTTTATTCTGCCCATTAACA
GTGCTTTGAACCCAATTCTCTATACTCTGACCACAAGACCATTTAAAGAAATGATTCATCGGTTTTGGTATAAC
TACAGACAAAGAAATCTATGGACAGCAAAGGTCAGAAAACATATGCTCCATCATTCATCTGGGTGGAAATGTG
GCCACTGCAGGAGATGCCACCTGAGTTAATGAAGCCGGACCTTTTCACATACCCCTGTGAAATGTCACTGATTT
CTCAATCAACGAGACTCAATTCCTATTCATGA
```

FIGURE 57

TAGAGATCCCTCGACCTCGACCCACGCGTCCGAGGAAAGAAAAAAAGAGGAATGGAAAGAGACAGAGAAAGGAA
ATGGGAGTGGAAGGAGGGAGGACTGCTTTGTAACTGCTAAGATTGCAGACAGAAATAGCACACAACCACTGTGA
GCTGTATGCGATTCAGAAACCAAGACCAAATTTTGCTCACTTTCATTAATCAGTTGCTCAGATAGAAGGAAATG
ACATCTGGTTCTGTCTTCTTCTACATCTTAATTTTTGGAAAATATTTTTCTCATGGGGGTGGACAGGATGTCAA
GTGCTCCCTTGGCTATTTCCCCTGTGGGAACATCACAAAGTGCTTGCCTCAGCTCCTGCACTGTAACGGTGTGG
ACGACTGCGGGAATCAGGCCGATGAGGACAACTGTGGAGACAACAATGGATGGTCTCTGCAATTTGACAAATAT
TTTGCCAGTTACTACAAAATGACTTCCCAATATCCTTTTGAGGCAGAAACACCTGAATGTTTGGTCGGTTCTGT
GCCAGTGCAATGTCTTTGCCAAGGTCTGGAGCTTGACTGTGATGAAACCAATTTACGAGCTGTTCCATCGGTTT
CTTCAAATGTGACTGCAATGTCACTTCAGTGGAACTTAATAAGAAAGCTTCCTCCTGATTGCTTCAAGAATTAT
CATGATCTTCAGAAGCTGTACCTGCAAAACAATAAGATTACATCCATCTCCATCTATGCTTTCAGAGGACTGAA
TAGCCTTACTAAACTGTATCTCAGTCATAACAGAATAACCTTCCTGAAGCCGGGTGTTTTTGAAGATCTTCACA
GACTAGAATGGCTGATAATTGAAGATAATCACCTCAGTCGAATTTCCCCACCAACATTTTATGGACTAAATTCT
CTTATTCTCTTAGTCCTGATGAATAACGTCCTCACCCGTTTACCTGATAAACCTCTCTGTCAACACATGCCAAG
ACTACATTGGCTGGACCTTGAAGGCAACCATATCCATAATTTAAGAAATTTGACTTTTATTTCCTGCAGTAATT
TAACTGTTTTAGTGATGAGGAAAAACAAAATTAATCACTTAAATGAAAATACTTTTGCACCTCTCCAGAAACTG
GATGAATTGGATTTAGGAAGTAATAAGATTGAAAATCTTCCACCGCTTATATTCAAGGACCTGAAGGAGCTGTC
ACAATTGAATCTTTCCTATAATCCAATCCAGAAAATTCAAGCAAACCAATTTGATTATCTTGTCAAACTCAAGT
CTCTCAGCCTAGAAGGGATTGAAATTTCAAATATCCAACAAGGATGTTTAGACCTCTTATGAATCTCTCTCAC
ATATATTTTAAGAAATTCCAGTACTGTGGGTATGCACCACATGTTCGCAGCTGTAAACCAAACACTGATGGAAT
TCATCTCTAGAGAATCTCTTGGCAAGCATTATTCAGAGAGTATTTGTCTGGGTTGTATCTGCAGTTACCTGCT
TTGGAAACATTTTTGTCATTTGCATGCGACCTTATATCAGGTCTGAGAACAAGCTGTATGCCATGTCAATCATT
TCTCTCTGCTGTGCCGACTGCTTAATGGGAATATATTTATTCGTGATCGGAGGCTTTGACCTAAAGTTTCGTGG
AGAATACAATAAGCATGCGCAGCTGTGGATGGAGAGTACTCATTGTCAGCTTGTAGGATCTTTGGCCATTCTGT
CCACAGAAGTATCAGTTTTACTGTTAACATTTCTGACATTGGAAAAATACATCTGCATTGTCTATCCTTTTAGA
TGTGTGAGACCTGGAAAATGCAGAACAATTACAGTTCTGATTCTCATTTGGATTACTGGTTTTATAGTGGCTTT
CATTCCATTGAGCAATAAGGAATTTTTCAAAAACTACTATGGCACCAATGGAGTATGCTTCCCTCTTCATTCAG
AAGATACAGAAAGTATTGGAGCCCAGATTTATTCAGTGGCAATTTTTCTTGGTATTAATTTGGCCGCATTTATC
ATCATAGTTTTTTTCCTATGGAAGCATGTTTTATAGTGTTCATCAAAGTGCCATAACAGCAACTGAAATACGGAA
TCAAGTTAAAAAAGAGATGATCCTTGCCAAACGTTTTTTCTTTATAGTATTTACTGATGCATTATGCTGGATAC
CCATTTTTGTAGTGAAATTTCTTTCACTGCTTCAGGTAGAAATACCAGGTACCATAACCTCTTGGGTAGTGATT
TTTATTCTGCCCATTAACAGTGCTTTGAACCCAATTCTCTATACTCTGACCACAAGACCATTTAAAGAAATGAT
TCATCGGTTTTGGTATAACTACAGACAAAGAAATCTATGGACAGCAAAGGTCAGAAAACATATGCTCCATCAT
TCATCTGGGTGGAAATGTGGCCACTGCAGGAGATGCCACCTGAGTTAATGAAGCCGGACCTTTTCACATACCCC
TGTGAAATGTCACTGATTTCTCAATCAACGAGACTCAATTCCTATTCATGACTGACTCTGAAATTCATTTCTTC
GCAGAGAATACTGTGGGGGTGCTTCATGAGGGATTTACTGGTATGAAATGAATACCACAAAATTAATTTATAAT
AATAGCTAAGATAAATATTTTACAAGGACATGAGGAAAAATAAAAATGACTAATGCTCTTACAAAGGGAAGTAA
TTATATCAATAATGTATATATATTAGTAGACATTTTGCATAAGAAATTAAGAGAAATCTACTTCAGTAACATTC
ATTCATTTTCTAACATGCATTTATTGAGTACCCACTACTATGTGCATAGCATTGCAATATAGTCCTGGAAGTA
GACAGTGCAGAACCTTTCAATCTGTAGATGGTGTTTAATGACAAAAGACTATACAAAGTCCATCTGCAGTTCCT
AGTTTAAAGTAGAGCTTTACCTGTCATGTGCATCAGCAAGAATCATAGGCACTTTTAAATAAAGGTTTAAAGTT
TTGGAAT

FIGURE 58

GATCCATTGTGCTGGCGCGGATTCTTTATCACTGGAAGGAGGAGGAGGGGGAGAGTCGCTCCCGCCGGGCGAGC
ATGGGGCGCCTGGCCTCGAGGCCGCTGCTGCTGGCGCTCCTGTCGTTGGCTCTTTGCCGAGGGCGTGTGGTGAG
AGTCCCCACAGCGACCCTGGTTCGAGTGGTGGGCACTGAGCTGGTCATCCCCTGCAACGTCAGTGACTATGATG
GCCCCAGCGAGCAAAACTTTGACTGGAGCTTCTCATCTTTGGGGAGCAGCTTTGTGGAGCTTGCAAGCACCTGG
GAGGTGGGGTTCCCAGCCCAGCTGTACCAGGAGCGGCTGCAGAGGGGCGAGATCCTGTTAAGGCGGACTGCCAA
CGACGCCGTGGAGCTCCACATAAAGAACGTCCAGCCTTCAGACCAAGGCCACTACAAATGTTCAACCCCCAGCA
CAGATGCCACTGTCCAGGGAAACTATGAGGACACAGTGCAGGTTAAAGTGCTGGCCGACTCCCTGCACGTGGGC
CCCAGCGCGCGGCCCCGCCGAGCCTGAGCCTGCGGGAGGGGGAGCCCTTCGAGCTGCGCTGCACCGCCGCCTC
CGCCTCGCCGCTGCACACGCACCTGGCGCTGCTGTGGGAGGTGCACCGCGGCCCGGCCAGGCGGAGCGTCCTCG
CCCTGACCCACGAGGGCAGGTTCCACCCGGGCCTGGGGTACGAGCAGCGCTACCACAGTGGGGACGTGCGCCTC
GACACCGTGGGCAGCGACGCCTACCGCCTCTCAGTGTCCCGGCTCTGTCTGCCGACCAGGGCTCCTACAGGTG
TATCGTCAGCGAGTGGATCGCCGAGCAGGGCAACTGGCAGGAAATCCAAGAAAAGGCCGTGGAAGTTGCCACCG
TGGTGATCCAGCCGACAGTTCTGCGAGCAGCTGTGCCCAAGAATGTGTCTGTGGCTGAAGGAAAGGAACTGGAC
CTGACCTGTAACATCACAACAGACCGAGCCGATGACGTCCGGCCCGAGGTGACGTGGTCCTTCAGCAGGATGCC
TGACAGCACCCTACCTGGCTCCCGCGTGTTGGCGCGGCTTGACCGTGATTCCCTGGTGCACAGCTCGCCTCATG
TTGCTTTGAGTCATGTGGATGCACGCTCCTACCATTTACTGGTTCGGGATGTTAGCAAAGAAAACTCTGGCTAC
TATTACTGCCACGTGTCCCTGTGGGCACCCGGACACAACAGGAGCTGGCACAAAGTGGCAGAGGCCGTGTCTTC
CCCAGCTGGTGTGGGTGTGACCTGGCTAGAACCAGACTACCAGGTGTACCTGAATGCTTCCAAGGTCCCCGGGT
TTGCGGATGACCCCACAGAGCTGGCATGCCGGGTGGTGGACACGAAGAGTGGGGAGGCGAATGTCCGATTCACG
GTTTCGTGGTACTACAGGATGAACCGGCGCAGCGACAATGTGGTGACCAGCGAGCTGCTTGCAGTCATGGACGG
GGACTGGACGCTAAAATATGGAGAGAGGAGCAAGCAGCGGGCCCAGGATGGAGACTTTATTTTTTCTAAGGAAC
ATACAGACACGTTCAATTTCCGGATCCAAAGGACTACAGAGGAAGACAGAGGCAATTATTACTGTGTTGTGTCT
GCCTGGACCAAACAGCGGAACAACAGCTGGGTGAAAAGCAAGGATGTCTTCTCCAAGCCTGTTAACATATTTTG
GGCATTAGAAGATTCCGTGCTTGTGGTGAAGGCGAGGCAGCCAAAGCCTTTCTTTGCTGCCGGAAATACATTTG
AGATGACTTGCAAAGTATCTTCCAAGAATATTAAGTCGCCACGCTACTCTGTTCTCATCATGGCTGAGAAGCCT
GTCGGCGACCTCTCCAGTCCCAATGAAACGAAGTACATCATCTCTCTGGACCAGGATTCTGTGGTGAAGCTGGA
GAATTGGACAGATGCATCACGGGTGGATGGCGTTGTTTTAGAAAAAGTGCAGGAGGATGAGTTCCGCTATCGAA
TGTACCAGACTCAGGTCTCAGACGCAGGGCTGTACCGCTGCATGGTGACAGCCTGGTCTCCTGTCAGGGGCAGC
CTTTGGCGAGAAGCAGCAACCAGTCTCTCCAATCCTATTGAGATAGACTTCCAAACCTCAGGTCCTATATTTAA
TGCTTCTGTGCATTCAGACACACCATCAGTAATTCGGGGAGATCTGATCAAATTGTTCTGTATCATCACTGTCG
AGGGAGCAGCACTGGATCCAGATGACATGGCCTTTGATGTGTCCTGGTTTGCGGTGCACTCTTTTGGCCTGGAC
AAGGCTCCTGTGCTCCTGTCTTCCCTGGATCGGAAGGGCATCGTGACCACCTCCCGGAGGGACTGGAAGAGCGA
CCTCAGCCTGGAGCGCGTGAGTGTGCTGGAATTCTTGCTGCAAGTGCATGGCTCCGAGGACCAGGACTTTGGCA
ACTACTACTGTTCCGTGACTCCATGGGTGAAGTCACCAACAGGTTCCTGGCAGAAGGAGGCAGAGATCCACTCC
AAGCCCGTTTTTATAACTGTGAAGATGGATGTGCTGAACGCCTTCAAGTATCCCTTGCTGATCGGCATCGGTCT
GTCCACGGTCATCGGGCTCCTGTCCTGTCTCATCGGGTACTGCAGCTCCCACTGGTGTTGTAAGAAGGAGGTTC
AGGAGACACGGCGCGAGCGCCGCAGGCTCATGTCGATGGAGATGGACTAGGCTGGCCCGGGAGGGGAGTGACAG
AGGGACGTTCTAGGAGCAATTGGGGCAAGAAGAGGACAGTGATATTTTAAAACAAAGTGTGTTACACTAAAAAC
CAGTCCTCTCTAATCTCAGGTGGGACTTGGCGCTCTCTCTTTTCTGCATGTCAAGTTCTGAGCGCGGACATGTT
TACCAGCACACGGCTCTTCTTCCCACGGCACTTTCTGATGTAACAATCGAGTGTGTGTTTTCCCAACTGCCAGT
GATAAAGAATCCGCGCCAGCACAATGGATCTCGAGGGATCTTCCATACCTACCAGTTCTGCGCCTGCAGGTC

FIGURE 59

CCCACGCGTCCGCGGTAAATCACTTCTTGGAGGTGCCCTGCACGCCGGTCCTGGGAGCAGGCGGCCTCCCGGGG
GTGCGGGAGCCCCACTCCTCCGTGGTGTGTTCCATTTGCTTCCCACATCTGGAGGAGCTGACGTGCCAGCCTCC
CCCAGCACCACCCAGGGACGGGAGGCATGAGCCGGTCAAGGCACCTGGGCAAAATCCGGAAGCGTCTGGAAGAT
GTCAAGAGCCAGTGGGTCCGGCCAGCCAGGGCTGACTTTAGTGACAACGAGAGTGCCCGGCTGGCCACGGACGC
CCTCTTGGATGGGGGTTCTGAAGCCTACTGGCGGGTGCTCAGCCAGGAAGGCGAGGTGGACTTCTTGTCCTCGG
TGGAGGCCCAGTACATCCAGGCCCAGGCCAGGGAGCCCCGTGTCCCCCAGACACCCTGGGAGGGGCGGAAGCA
GGCCCTAAGGGACTGGACTCCAGCTCCCTACAGTCCGGCACCTACTTCCCTGTGGCCTCAGAGGGCAGCGAGCC
GGCCCTACTGCACAGCTGGGCCTCAGCTGAGAAGCCCTACCTGAAGGAAAAATCCAGCGCCACTGTGTACTTCC
AGACCGTCAAGCACAACAACATCAGAGACCTCGTCCGCCGCTGCATCACCCGGACTAGCCAGGTCCTGGTCATC
CTGATGGATGTGTTCACGGATGTGGAGATCTTCTGTGACATTCTAGAGGCAGCCAACAAGCGTGGGGTGTTCGT
TTGTGTGCTCCTGGACCAGGGAGGTGTGAAGCTCTTCCAGGAGATGTGTGACAAAGTCCAGATCTCTGACAGTC
ACCTCAAGAACATTTCCATCCGGAGTGTGGAAGGAGAGATATACTGTGCCAAGTCAGGCAGGAAATTCGCTGGC
CAAATCCGGGAGAAGTTCATCATCTCGGACTGGAGATTTGTCCTGTCTGGATCTTACAGCTTCACCTGGCTCTG
CGGACACGTGCACCGGAACATCCTCTCCAAGTTCACAGGCCAGGCGGTGGAGCTGTTTGACGAGGAGTTCCGCC
ACCTCTACGCCTCCTCCAAGCCTGTGATGGGCCTGAAGTCCCCGCGGCTGGTCGCCCCGTCCCGCCCGGAGCA
GCCCCGGCCAATGGCCGCCTTAGCAGCAGCAGTGGCTCCGCCAGTGACCGCACGTCCTCCAACCCCTTCAGCGG
CCGCTCGGCAGGCAGCCACCCCGGTACCCGAAGTGTGTCCGCGTCTTCAGGGCCCTGTAGCCCCGCGGCCCCAC
ACCCGCCTCCACCGCCCCGGTTCCAGCCCCACCAAGGCCCTTGGGGAGCCCCGAGTCCCCAGGCCCACCTCTCC
CCGCGGCCCCACGACGGCCCGCCCGCCGCTGTCTACAGCAACCTGGGGGCCTACAGGCCCACGCGGCTGCAGCT
GGAGCAGCTGGGCCTGGTGCCGAGGCTGACTCCAACCTGGAGGCCCTTCCTGCAGGCCTCCCCTCACTTCTGAA
GGTCCCATCCCCTGCTGCCCTCCGCAGGCCCAGGCTGGGCACTCCCTGAGACCCAAAGACCCACCTCAACGAC
GAGTGGCGTTGAGCCACTTCCCTTTGAAAAGACACTCAAAATCACTGCCATGGTTCAATGTTCCCAGGCCCCAG
GCCATCCACTTGCCGGCCCCCACCAGTTCTTGGGTTCCCCGCTCTAGTTTGACCTGTGCAGCACATTCCAGAAG
GTTCCAGGGGAGGTTGTGGGGCAGCTAGAGGACAAAATCATGAAAACAGAGTCCCTGTCTTCCAGAGATCATCC
GGGGCTTTAATATTAATGGCCCCCAAAACTCCGTAAGAAGCAGGAAATGCAGCCCAAGTTTTACAAATGGGTAA
ACAGAGGCACTGAGAGATAGATGGTAGTTTGGTACTTCTGGTTCCCAGTGCCCAGGAATGGTCCACTCCCAAGA
AATTCAGGAAAGAAAGACTGAGGAGAAGGTGTGGGAACATTCTGGATGTTTCGGGAGAGTTGGGGAAACTCCTC
CTCCTTAGGAAAGGCTAATACTAGGGTATCCTTGGGCCCAATGAATTAGGGGTGAGGCCCCAGAACCCGTTATCT
ATGAGTTGTATGGGGGAGCCATCTGAAGCTGTAGCCACCAGGGATGCAGCTAGCTGAGGAGTTTGGGGTGTTGG
GTTGGACAAGGCAGGTTAGTAGACTCAGATTCTTGCTTCAAAGAGCCTTGGGCTGGCCTGGAGGTCCCTGGAGT
CTAGACTGGACCTAGGAGCTTGAGTTGTCAGGGGCCAGGACTGGCCCCACTGCAGTGCCCAGGCCAGTCTTGAG
CAGCAGGGAGGGCTCAGCTGTCCCCAGATCCAGGTGCCTCTGACCAGCCTGGTCACCTCCTGAGGAATAAATGC
TGAACCTCACAAGCCCCATCATTCATTTCTTCTCAATTCACAGTGCCCCTCTTTGTTTCTGGGGTGGAACTAGG
TCCTGAGGGCACAGCCTAGCTGAGTGCAAAGAAATATAGGATGCTTAGAAAGCATACAGGAGGGGCCAGGCGTG
GTGGCTCATGCCTGTAATCCCAGAACTTTGGGATGCCAAGGTGGTTGGATTACCTGAGATCAGGTGGATTACCT
GGTCTCGAGACCAGCCTGACCAATATGGTGAAACCCCGTCTCTACTAAAAATACAAAAATTAGGCTGAGACAGG
AGAATTGCTTGAACCCAGGAAGCAGAGGTTGCAATGAGCTGAGATTGCATCACTGCACTCCAGCATGGGCAACA
AAGCAAGACTCCGTCACAGAAAAAAAAAAAAAA

FIGURE 60

ATGGCTCTGCCGCAGCCGCCGCCGCCCGCCGGGGCGCGTGACCCGGTGACCCCGGAGCACTGGGCATCCGGACC
CCCCTCGCAGGCGCAGCCGCTATTAAGGCAGGAGGCTAAAGAGGAGGAGGAAGGGGAGGAGACAGGCGTCCAGG
GCGCCTGGGGAACCGGCACGGCGGAGCAGCGGCGGCGGGGCTGGGGGGAGGCCGCCGAGTCGGCCGCGGCCGAG
GAGGGGCAGGCGGAGGTCGGGGGCGCCGCGGCCGCGGGGTCAGGTTCCCCGGCGGGAGGCGCAGGTGGCGGCCT
GGGGAGCTGGCGGCCGCTCCTCGCCTGGCTGCAGCGGCGGCAGCCCAGTGCTGCCCCTGTGCGGCGCCCCTTT
CCCGCTCCGCCGCGCACTGTTGTCATGGAGGAACCAAGATGGCGGCTCTGGCCTACAACCTGGGCAAGCGGGAG
ATCAACCACTACTTCAGCGTGAGGAGCGCCAAGGTGCTGGCGCTGGTGGCCGTGCTGCTGCTCGCAGCGTGCCA
CCTCGCCTCCCGCCGCTACCGAGGCAATGATTCGTGTGAATACCTTCTCTCAAGTGGCAGATTTCTTGGAGAGA
AAGTTTGGCAACCTCACAGTTGTATGATGCATAAATACAAAATCAGTGAAGCAAAGAACTGCCTTGTAGATAAA
CATATTGCATTTATTGGAGATTCCAGAATTCGTCAATTGTTTTATTCTTTTGTAAAAATAATTAATCCCCAATT
CAAAGAAGAAGGAAATAAGCATGAAAACATTCCTTTTGAAGACAAGACTGCATCAGTTAAAGTGGATTTTCTGT
GGCATCCTGAAGTTAATGGTTCTATGAAACAGTGTATCAAAGTGTGGACTGAGGATTCCATTGCAAAGCCACAT
GTGATTGTAGCAGGAGCTGCCACATGGTCCATCAAGATTCACAATGGTAGCAGTGAAGCGCTTTCTCAATATAA
AATGAACATCACCTCCATAGCACCACTTTTAGAAAAATTGGCAAAGACTAGTGATGTTATTGGGTCTTACAAG
ATCCTGTTTATGAAGATCTATTAAGTGAAAATAGGAAGATGATCACTAATGAAGATAGATGCTTACAATGAA
GCTGCAGTCAGTATTTTGAATAGTAGCACCAGAAATTCTAAATCAAATGTTAAGATGTTCAGTGTTTCCAAATT
AATTGCTCAAGAAACCATCATGGAATCTTTGGATGGCTTACATCTTCCTGAATCGAGCAGAGAAACTACTGCAA
TGATTCTTATGAATGTGTATTGCAATAAGATTTGAAGCCTGTAGATGGGTCCTGTTGTCAACCTCGGCCTCCT
GTTACTCTCATACAGAAGCTAGCTGCTTGTTTTTCACTTTATCTATTATCGGATATTTAATTTTTTACATAAT
TCATCGTAATGCTCATCGGAAGAATAAGCCGTGTACTGATTTGGAAAGTGGAGAGGAAAAGAAAAATATTATCA
ATACCCCTGTGTCTTCATTAGAAATACTTTTACAATCTTTCTGCAAACTTGGCCTGATTATGGCATATTTCTAT
ATGTGTGACCGTGCAAATCTGTTCATGAAGGAAAACAAATTTTATACACATTCATCTTTCTTTATTCCAATTAT
CTACATTTTGGTTTTGGGAGTATTTTATAATGAAAATACTAAAGAGACTAAAGTATTAAATAGAGAACAAACAG
ACGAATGGAAAGCTGGATGCAACTTGTGATTTTGATTTATCACATTTCTGGAGCAAGTACATTTTGCCTGTA
TACATGCACATTCGAGTTCTGGTTGCTGCATATTTATTTCAGACAGGGTATGGGCATTTCTCATACTTTTGGAT
AAAAGGAGATTTTGGAATCTATAGAGTATGTCAGGTTTTATTTCGTCTCAATTTCCTGGTAGTGGTGTTATGTA
TAGTAATGGATCGACCTTATCAATTCTATTACTTTGTCCCCTTGGTCACTGTATGGTTCATGGTCATATATGTT
ACTTTAGCACTATGGCCACAATAATCCAAAAAAAAGCAAACGGAAATTGTTTCTGGCATTTTGGCTTACTGTT
GAAACTAGGCTTTTTGCTGTTATTCATATGTTTTTTGGCATATTCTCAGGGTGCATTTGAGAAGATCTTTTCTC
TTTGGCCATTGTCCAAGTGTTTTGAACTGAAAGGGAATGTATATGAATGGTGGTTCAGATGGAGGTTAGACCGT
TATGTAGTTTTCCACGGAATGCTGTTTGCTTTTATTTATCGGCTTTGCAGAAGCGTCAAATACTTTCTGAAGG
AAAGGGTGAACCTCTTTTTTCAAACAAAATTTCAAATTTTCTGTTGTTTATTTCAGTAGTTTCTTTCTTGACCT
ATTCCATCTGGGCTAGCAGTTGTAAAAACAAAGCAGAGTGCAATGAACTCCATCCGTCTGTTTCTGTGGTACAG
ATTTTAGCCTTCATCCTAATAAGAAACATCCCTGGATATGCCCGTTCAGTTTACAGTTCATTTTTTGCTTGGTT
TGGAAAAATTTCATTAGAGCTATTTATTTGCCAGTATCACATATGGCTGGCAGCGGACACAAGGGGTATCTTGG
TACTGATACCTGGAAACCCTATGCTCAACATCATTGTCAGCACTTTCATATTTGTTGTGTGGCACATGAAATT
TCTCAGATCACTAATGATCTTGCACAGATTATTATTCCTAAAGATAACTCATCTCTCTTGAAAAGGTTGGCATG
TATAGCTGCATTTTTTTGTGGACTCCTCATCTTATCATCCATTCAAGATAAATCAAAACATTAGGTTCCAAAAA
TTCTAAAAAACCTAAACTCTTCAGGCTACCTTTGTGTGTCTCTAGAAGAGAAAAGCATCTATCTGGAGATATAA
ATGTGTWTGTAAATATAAACGTTTGTGGCAAGAGGACAGTTCTGTGACATCTGTTGAACATATGTGGTTGTATA
TATTGGAAATGTACATATCCAATATGAAATACTAAAACAAACAAACAAAAAACCAGAATGCATTGTATAG
GATTGCATGTGAAGTCTTTCTACTGAATCTATATTTCCATTTGTAAGTGATTTTAAGTTAACATATGAAGGCA
GGGAAATGATTACCTTTCCAGTAAAAGTATAGATAATTTAATTAACTTAGTGACACCA:CCAAGTGTTTTGAT
ATAACTAAATTTGTGGTAATAAGACTGTCTGCACCTGTATTCATTGTGGAACTTCCTCTTTCATTGGAAACTTT
CTTACTCAAGAATGACGGCAGTATTGTTTTCTTATATGTGCAATGAAGTGGAATGATAAACAGTATGCCTTTAA
TTTATATGTGTTCTTGTTCTGATGTTGTTTCCTGAAATGATTTTTCTTCCTAACTGTGGTTTTCGGGTATGCAA
GCCTAAATCTTTGTACACTTTGTCTCACAGAATAGTTCTGAGGCTCCATGACAGGGTTTTGTCATTGTTGATGT
TATTGTTGCTTCGTTTTATAAAAAAGCCAAAATTTTTTTCCAATCCAAACGTTCACCTGTTTCCTTTCCTCAA
GCTATACCAGTGTAATACCAGTTACCCTGTGGATCCATTTAATATGTTATCCCCACTAATTAATTTTCGTATAT
TATTTCCAATATTTGGAAAGCTCTTTATAGCCATTTGGTATTTCCTATTACCCACCTCCTATTTTAAATATTTA
TCAGTCTAAACTTGTGCAGTGTAGTAAACATGCAAGTTGTTACGATTGAGCTGTATTACCATAAGTAGAATTTT
AAGTAAACTGGTGAATTTGGGCAATAAATGTTTTGCTTTTGTTTGATTTTTTTTACAAGCTAACTGTTAGA
GGTATACATTTATTTATCTGTTGTACAGATTTGATTATGATTTTAATGTTTGAAAGATTGCACTTGTTTGCTTT
TACTATATGTGGGTAAAATATATTTTCTGTTCACAGTATATGAAAATATGGAGTAATTTAAACAGTAAATAAA
CATTCTGTGGATGCTTATTTTTGTATTGGCAAAGTATCAATTAAACTATATGTGTTCTTTTTCAA

FIGURE 61A

```
GAAAGACATACACACTTCATGTAATGCTACCTGCAAGTCTCCCTAGAAAAGCAGTTTTTGTAGGTGAAAACAAT
GAAGCCAGGTAATATTGCAAGGAGGCTGTAATTTTAGCAGACCTACCAACAACACTGATGTAGGAAGCTCATTA
TTTTAATTTCTGGAGCCTTTTAATTTTTTCTTTAGAAAGTGTATAAATAATTGCAGTGCTGCTTTGCTTCCAAA
ACTGGGCAGTGAGTTCAACAACAACGACAACAACAGCCGCAGCTCATCCTGGCCGTCATGGAGTTTCTTGAAAG
AACGTATCTTGTGAATGATAAAGCTGCCAAGATGTATGCTTTCACACTAGAAGAAGGAGCTGCAAATGAACAC
TTCATAGCAATGTGGAACTCCAACAGAAACCGGTGAATAAAGATCAGTGTCCCAGAGAGAGACCAGAGGAGCTG
GAGTCAGGAGGCATGTACCACTGCCACAGTGGCTCCAAGCCCACAGAAAGGGGGCGAATGAGTACGCCTATGC
CAAGTGGAAACTCTGTTCTGCTTCAGCAATATGCTTCATTTTCATGATTGCAGAGGTCGTGGGTGGGCACATTG
CTGGGAGTCTTGCTGTTGTCACAGATGCTGCCCACCTCTTAATTGACCTGACCAGTTTCCTGCTCAGTCTCTTC
TCCCTGTGGTTGTCATCGAAGCCTCCCTCTAAGCGGCTGACATTTGGATGGCACCGAGCAGAGATCCTTGGTGC
CCTGCTCTCCATCCTGTGCATCGGGTGGTGACTGGCGTGCTAGTGTACCTGGCATGTGAGCGCCTGCTGTATC
CTGATTACCAGATCCAGGCGACTGTGATGATCATCGTTTCCAGCTGCGCAGTGGCGGCCAACATTGTACTAACT
GTGGTTTTGCACCAGAGATGCCTTGGCCACAATCACAAGGAAGTACAAGCCAATGCCAGCGTCAGAGCTGCTTT
TGTGCATGCCCTTGGAGATCTATTTCAGAGTATCAGTGTGCTAATTAGTGCACTTATTATCTACTTTAAGCCAG
AGTATAAAATAGCCGACCCAATCTGCACATTCATCTTTTCCATCCTGGTCTTGGCCAGCACCATCACTATCTTA
AAGGACTTCTCCATCTTACTCATGGAAGGTGTGCCAAAGAGCCTGAATTACAGTGGTGTGAAAGAGCTTATTTT
AGCAGTCGACGGGGTGCTGTCTGTGCACAGCCTGCACATCTGGTCTCTAACAATGAATCAAGTAATTCTCTCAG
CTCATGTTGCTACAGCAGCCAGCCGGGACAGCCAAGTGGTTCGGAGAGAAATTGCTAAAGCCCTTAGCAAAAGC
TTTACGATGCACTCACTCACCATTCAGATGGAATCTCCAGTTGACCAGGACCCCGACTGCCTTTTCTGTGAAGA
CCCCTGTGACTAGCTCAGTCACACCGTCAGTTTCCCAAATTTGACAGGCCACCTTCAAACATGCTGCTATGCAG
TTTCTGCATCATAGAAAATAAGGAACCAAAGGAAGAAATTCATGTCATGGTGCAATGCACATTTTATCTATTTA
TTTAGTTCCATTCACCATGAAGGAAGAGGCACTGAGATCCATCAATCAATTGGATTATATACTGATCAGTAGCT
GTGTTCAATTGCAGGAATGTGTATATAGATTATTCCTGAGTGGAGCCGAAGTAACAGCTGTTTGTAACTATCGG
CAATACCAAATTCATCTCCCTTCCAATAATGCATCTTGAGAACACATAGGTAAATTTGAACTCAGGAAAGTCTT
ACTAGAAATCAGTGGAAGGGACAAATAGTCACAAAATTTTACCAAAACATTAGAAACAAAAAATAAGGAGAGCC
AAGTCAGGAATAAAAGTGACTCTGTATGCTAACGCCACATTAGAACTTGGTTCTCTCACCAAGCTGTAATGTGA
TTTTTTTTTCTACTCTGAATTGGAAATATGTATGAATATACAGAGAAGTGCTTACAACTAATTTTTATTTACTT
GTCACATTTTGGCAATAAATCCCTCTTATTTCTAAATTCTAACTTGTTTATTTCAAAACTTTATATAATCACTG
TTCAAAAGGAAATATTTTCACCTACCAGAGTGCTTAAACACTGGCACCAGCCAAAGAATGTGGTTGTAGAGACC
CAGAAGTCTTCAAGAACAGCCGACAAAAACATTCGAGTTGACCCCACCAAGTTGTTGCCACAGATAATTTAGAT
ATTTACCTGCAAGAAGGAATAAAGCAGATGCAACCAATTCATTCAGTCCACGAGCATGATGTGAGCACTGCTTT
GTGCTAGACATTGGGCTTAGCATTGAAACTATAAAGAGGAATCAGACGCAGCAAGTGCTTCTGTGTTCTGGTAG
CAACTCAACACTATCTGTGGAGAGTAAACTGAAGATGTGCAGGCCAACATTCTGGAAATCCTATGTCACTGGGT
TTGGTTTGGAAACCTGGACTTCTGCATTTTTAAAAGTTACCCAGAGATGCTTCTAAAGATGAGCCATAGTCTAG
AAGATTGTCAACCACAGGAGTTCATTGAGTGGGACAGCTAGAYACATACATTGGCAGCTACAATAGTATCATGA
ATTGCAATGATGTAGTGGGGTATAAAAGGAAAGCGATGGATATTGCCGGATGGGCATGGCCAGTGATGTTTCAC
GTCATTGAGGTGACAGCTCTGCTGGACTTTGAATTACATATGGAGGCTCTCCAGGAAGACGAAGAAGAGAAGGA
CATTCTAGGCAAAAGAAGACTAGGCACAAGGCACACTTATGTTTGTCTGTTAGCTTTTAGTTGAAAAGCAAA
ATACATGATGCAAAGAAACCTCTCCACGCTGTGATTTTTAAAACTACATACTTTTGCAACTTTATGGTTATGA
GTATTGTAGAGAACAGGAGATAGGTCTTAGATGATTTTTATGTTGTTGTCAGACTCTAGCAAGGTACTAGAAAC
CTAGCAGGCATTAATAATTGTTGAGGCAATGACTCTGAGGCTATATCTGGGCCTTGTCATTATTTATCATTTAT
ATTTGTATTTTTTCTGAAATTTGAGGGCCAAGAAAACATTGACTTTGACTGAGGAGGTCACATCTGTGCCATC
TCTGCAAATCAATCAGCACCACTGAAATAACTACTTAGCATTCTGCTGAGCTTTCCCTGCTCAGTAGAGACAAA
TATACTCATCCCCCACCTCAGTGAGCTTGTTTAGGCAACCAGGATTAGAGCTGCTCAGGTTCCCAACGTCTCCT
GCCACATCGGGTTCTCAAAATGGAAAGAATGGTTTATGCCAAATCACTTTTCCTGTCTGAAGGACCACTGAATG
GTTTTGTTTTTCCATATTTTGCATAGGACGCCCTAAAGACTAGGTGACTTGGCAAACACAAGTGTTAGTATA
ATTCTTTGCTTCTGCTTCTTTTTGAAAATCATGTTTTAGATTTGATTTTAAGTCAGAAATTCACTGAATGTCAGG
TAATCATTATGGAGGGAGATTTGTGTGTCAACCAAAGTAATTGTCCCATGGCCCCAGGGTATTTCTGTTGTTTC
CCTGAAATTCTGCTTTTTTAGTCAGCTAGATTGAAAACTCTGAACAGTAGATGTTTATATGGCAAAATGCAAGA
CAATCTATAAGGGAGATTTTAAGGATTTTGAGATGAAAAAACAGATGCTACTCAGGGGCTTTATGGACCATCCA
TCAATTCTGAAGTTCTGACTCTCCCATTACCCTTTCCCTGGTGTGGTCAGAACTCCAGGTCACTGGAAGTTAGT
GGAATCATGTAGTTGAATTCTTTACTTCAAGACATTGTATTCTCTCCAGCTATCAAAACATTAATGATCTTTTA
TGTCTTTTTTTTGTTATTGTTATACTTTAAGTTCTGGGGTACATGTGCGGAACATGTAGGTTTGTTACATAGGT
ATACATGTGCCATGGTGGTTTGCTGCACTCATCAACCTGTCATCTACATTCTTTATGTCTGTCTTTCAAAGCA
ACACTCTGTTCTTCTGAGTAGTGAAATCAGGTCAACTTTACCACCAGCCTCCATTTTAATATGCTTCACCATC
ATCCAGCACCTACTTAAGATTTATCTAGGGCTCTGTGGTGATGTTAGGACCCATAAAAGAAATTTATGCCTTCC
ATATGTTTGGTTACAGATGGGAAATGGGAATGTTGAAGGACATGAAAGAAGGATGTTTACACATTAAGCATCA
GTTCTGAAGCTAGATTGTCTGAGTTTGAATCTTAGCTCTTCCCTTTATTAGCTCTGTGACCTCGAGCTAGTTAC
TTAAATGCTCTGATCCTCTATTTCCTGATCAGTGAAACCTCCCTATTCAAATGTGTGAGAGTTTAATAAATTAG
GACACTTAAAAATGTTGGAGCAGTGCATAGCATGTAGTGTTCAGTACATGTTAAATGTTGTTTTTATTATGTA
CAAACATGTGTGGGCACAGAATTTTAAATCATCTCAACTTTTGAGAAATTTGAGTTATCAACACCGTTCCCAC
```

FIGURE 61B

```
AAGACAGTGGCAAAATTATTGGTGAGAATTAAACAGCTGTTTCTCAGAGGAAGCAATGGAGGCTTGCTGGGATA
AAGGCATTTACTGAGAGGCTGTTACCTAGTGAGAGTGATGAATTAATTAAAATAGTCGAATCCCTTTCTGACTG
TCTCTGAAAGCTTCCGCTTTTATCTTTGAAGAGCAGAATTGTCACCCCAAGGACATTTATTAATAAAAAGAACA
ACTGTCCAGTGCAATGAAGGCAAAGTCATAGGTCTCCCAAGTCTTACCCCATTCCTGTGAAATATCAAGTTCTT
GGCTTTTCTCTGTCATGTAGCCTCAACTTTCTCCGACCGGGTGCATTTCTTTCTCTGGTTTCTAAATTGCCAGT
GGCAAATTTGGATCACTTACTTAATATCTGTTAAATTTTGTGACCCAACAAAGTCTTTTAGCACTGTGGTGTCA
AAAAGAAAAACACCTCCCAGGCATATACATTTTATAGATTCCTGGAGAATGTTGCTCTCCAGCTCCATCCCCAC
CCAATGAAATATGATCCAGAGAGTCTTGCAAAGAGACAAGCCTCATTTTCCACAATTAGCTCTAAAGTGCCTCC
AGGAAATGATTTTCTCAGCTCATCTCTCTGTATTCCCTGTTTTGGATCACAGGGCAATCTGTTTAAATGACTAA
TTACAGAAATCATTAAAGGCACCAAGCAAATGTCATCTCTGAATACACACATCCCAAGCTTTACAAATCCTGCC
TGGCTTGACAGTGATGAGGCCACTTAACAGTCCAGCGCAGGCGGATGTTAAAAAAAATAAAAAGGTGACCATCT
GCGGTTTAGTTTTTTAACTTTCTGATTTCACACTTAACGTCTGTCATTCTGTTACTGGGCACCTGTTTAAATTC
TATTTTAAAATGTTAATGAGTGTTGTTTAAAATAAAATCAGGAAAGAGAGAAAAAAAAAAAAAAAAAAAA
```

FIGURE 62A

```
GCGGCGGGAGAGCTGCTGGCTCGCCCGGATCCCGGGAGCTGCCTGGAGGCGGGCCCGGCCCGGGGAAGGTGAGC
GGCTGCGGGACCCAGCCCCTCGCCGGGAGCGGGCACCATGGTGCTGTCGGTGCCTGTGATCGCGCTGGGCGCCA
CGCTGGGCACAGCCACCAGCATCCTCGCGTTGTGCGGGGTCACCTGCCTGTGTCGGCACATGCACCCCAAGAAG
GGGCTGCTGCCGCGGGACCAGGACCCCGACCTGGAGAAGGCGAAGCCCAGCTTGCTCGGGTCTGCACAACAGTT
CAATGTTAAAAAGTCCACGGAACCTGTTCAGCCCCGTGCCCTCCTCAAGTTCCCAGACATCTATGGACCCAGGC
CAGCTGTGACGGCTCCAGAGGTCATCAACTATGCAGACTATTCACTGAGGTCTACGGAGGAGCCCACTGCACCT
GCCAGCCCCCAACCCCCGAATGACAGTCGCCTCAAGAGGCAGGTCACAGAGGAGCTGTTCATCCTCCCTCAGAA
TGGTGTGGTGGAGGATGTCTGTGTCATGGAGACCTGGAACCCAGAGAAGGCTGCCAGTTGGAACCAGGCCCCA
AACTCCACTACTGCCTGGACTATGACTGTCAGAAGGCAGAATTGTTTGTGACTCGCCTGGAAGCTGTGACCAGC
AACCACGACGGAGGCTGTGACTGCTACGTCCAAGGGAGTGGTGCCAATAGGACCGGCTCTGTGGAGGCTCAGAC
AGCCCTAAAGAAGCGGCAGCTGCACACCACCTGGGAGGAGGGCCTGGTGCTCCCCCTGGCGGAGGAGGAGCTCC
CCACAGCCACCCTGACGCTGACCTTGAGGACCTGCGACCGCTTCTCCCGTCACAGCGTGGCCGGGGAGCTCCGC
CTGGGCCTGGACGGGACATCTGTGCCTCTAGGGGCTGCCCAGTGGGGCGAGCTGAAGACTTCAGCGAAGGAGCC
ATCTGCAGGAGCTGGAGAGGTCCTACTATCCATCAGCTACCTCCCGGCTGCCAACCGCCTCCTGGTGGTGCTGA
TTAAAGCCAAGAACCTCCACTCTAACCAGTCCAAGGAGCTCCTGGGGAAGGATGTCTCTGTCAAGGTGACCTTG
AAGCACCAGGCTCGGAAGCTGAAGAAGAAGCAGACTAAACGAGCTAAGCACAAGATCAACCCCGTGTGGAACGA
GATGATCATGTTTGAGCTGCCTGACGACCTGCTGCAGGCCTCCAGTGTGGAGCTGGAAGTGCTGGGCCAGGACG
ATTCAGGGCAGAGCTGTGCGCTTGGCCACTGCAGCCTGGGCCTGCACACCTCGGGCTCTGAGCGCAGCCACTGG
GAGGAGATGCTCAAAAACCCTCGCCGGCAGATTGCCATGTGGCACCAGCTGCACCTGTAACCAGCTGCCCAGCT
GCCTCCCTTCTTGGACAGCCCTGACCCGTCCTCTGCAACCTCCTTTCTGTGCCCCTTTCCTCATTCTGACACCC
AGAAGACAGTGACAGATGTGTTTGCAAGGCTGGGATGGCTCTCTCATCATACTCTTGTTTCTTAGAAATAAGCA
AGACAGAGCAGGAAATGGAATATGCGGGTCACACTGAGGAATGCATTTTGCTCATCTGTGTTATTGAAGGAGGT
GCTTATTAAATACAGTTCCTATGCCTGTTTTATAGGTGGGGTTAGGCCAGATGCAGAGAAAGCTAAATGTGGGA
ATCATGGATGCAAAGAAGAATTTGGCTTTTTGAAAAACAAGCATTTCAAAAATGATGAAGGAAGTGAAAGTATC
CTGGATCAACTCCTAGAGTTAGAGATTGCCCAGGTGGAAAGAAACCTTAGCCAGCGTTCAATCAAGCTCACCAT
GCAGGGCAGTCACCCGGCAGTTCTCAAACTTTAGCATGTGAAGAGTCACCAGCAGATTCCTGGGCTCGCCTGGA
GACATTCCTAGTCGGTATTCCTGGTCGAAGCCCAGGAGCCTTCCTTTTTAACAAGCTGATGTAGAGGGTGGAGC
ACTGTATGTGGAGAAATTCCTTCTACAATATTCCACACAGGTTTTTGGCCACAGTCCTTGATGGAGTCCCAAAA
CCATGGTGCAGCCAGTTCCAATGCTGGACACCTCAACCATCAGGGTGAAATCTGGGGCCTCAGCTTTTTAATTT
AATTATTTTAATTCTTAATACTTTAATTTGTGCATTTCATAAGCCCCCTGCTCTTGGACTGAATTTTGTGCTTT
TTATTGAAGAATTTTATTGTTTTTATCTTAAAATCAGTTTCTATTATCCTTGGGGAGACCATCCCTAACAAAGT
ACAGGTGGGATCTCCTGTGAGTCATTGGCTGGGTTCTGATTGCTAGATGTCACACCCACCAGCATCACCAAAGT
GACTCTGAGATAGACCGGTCCCTTCTCAGCGTTCCAGTCACTTCAGGAGGAATTTAGTTATTGACTTAGTCTAT
GACATCTGGCTACATGTAGGTAGAGAAGAAAGACAATTTTAAAAAGGAAATCAGGTCTTTTGCAACTGTGCCTC
CCTCTGTCTGTTTTCACTTGAATGGGTAAATAACCAGCAGCTAGGTTTTGAATTCCTACCTTGTTATTCTAAAC
AGATGTCCACATTGTTAATTAAATCTAAATTATGAGCCTTGCTGAGTGGATACGGTACTTACACCTGAACCAGG
ATTCCTGGGTTCTGTTGTTGACATTGCCCTTCAGCACCTGTTTGGCCAGCTGTATAAGATAGGACTAATGACTA
GGAAGCCTACCCCAATGAATGATATACTAGATGAAATAGTGTTCAAAACCTGTAGGCACTCTCTGGCTAAAAAC
AAACTCTGAGGCCACCAGCAGATCATCTTTAAGCTAAGTTACTATTTTTCACCTTTTTTTTAGACGGAGTTTT
GCTCTTTGTTGCCCAGGCTGGAGTGCAGTGGCACGATCTCGGCTCACTGCAACCTCCGCCTCCCAAGTTCAAGC
GATTCTCCTGTCTCAGCCTCCTGGGTAGCTGGGATTACAGGTGCCCACCAACATGCCTGGCTAATTTTGTACT
TTTAGTAGAGATGGGGTTTCACCATGTTGGCCAGGCTGGTCTTCAACTCCAGATCTCAGGTGATCTACCCTCCT
CGGCCTCCCAAAGTACTGGGATTACAGGCCTGAGCCACCGCGCCCGGCCTATTTTTCACTTTAATTTGGCAGCT
GAGAATGCCCAAAAAGTGCCAGAAGCATCGTGGCATTTCCAGAACCATGGATTCTGCCTTTGGACCCCTCTCTA
TTAATATTAAAACTCTGGGCCTTCAGATGTCACCCTAATCCACTGCCCTAAGACAGAATTTCTGGACAAGATGG
GTAAGGGCTTCATTCCTTCAACAAGTCAAGTCATACTTGGCCTCTCCCTGAGAATCTGAGCAGGAGCCTTATAA
CCTGTGGTCATTATTTTTTCTTTCTGTACAGAAATAGAAAAGCATTAGAAATAACTTCTAACCATCCTCTGAAA
AAACAGAAAAAATATCGAATCCCTCTTTCATGAGAAGTCTTTTGGATAATTGGAAACCTTCATCACTGAGGTTG
GCCAGCCCCTGCCAAGTGTTGTGTAGGCAAAGCACTTGTTAGTGGCTTCCTATGAAATGTTTAGAGATCTCTT
CACCATACTGGTTTCTTCTCTTTGGTTGGTGTGGGTAAAAGAAAACAAAACATTTCCTATAAGCTGAAAGCTGA
CCAGCATTCTCTTCTTGGTAACATCTACTACTCCAACCTAGAAAATTTGGATTCTAGACCAAAAATCAGGAAAC
ATGGCTCCTTATAAATCTGTGCAGCTGCCTTATAGTACCATCAAAGGAATTTCAGGTGGGCTGGGCGGGGCCCC
GATCCCAGAATTATCAACTCCACCCATCATCATTTGGTCATGAAGCATCCTTTCATTCTTCTTCTTCTTTTTTT
TGGGGGGGCGGGGCGGGGGAGGGATCTCAAAGTTTTAGTCTTCCAGAATCCAAATTAAAGGTTGCCCCTGATG
GGGGCCAGGTTCCGCCCACAGAACATCTTAGATGTCAGCCTTGACCTCACTTAGCAGGGATTACAGAAATGAGAT
ACATTTTGAAGGAGAGTTGTCTGTTATGTTCACTGTATTCTAAGTGCCTGGGATAAAGCTGTCTCATGGGTGCT
CCATATATATTCATATATATTTGTTGAGTGAATTAATGAATTAAGAGTGGCTGGCAGAGTAGGCAGAAAAAGAC
ACTGCAAATGGCATAAAAATTAAAGTCCTAGCTGAGTTCTCAATGGTAAAGGCATCAGATGTCTTAGCAGTCAA
GCTAGAAATTCATGACAATGAGTATTACTATTTGCCTAATGACAACTCATTGCTCTCCATGTAAATGTAATCAA
CAGATGAAGAGAATATAATTGCTCTGCTTTTCCACTAAAACTCCATCTTAGTGAATTTTAAATTATCCAGAGAT
GTCAAACTGCCAAATAAAAATATTTCAGTAGTCTTTGCATCAGCTTACCTTGTACCAGAAACATTTCCAATTTA
```

FIGURE 62B

```
CTATCAAATTATAGTAACTGAGCCTGTGTGAAGTATCTCATCATTTTCGAAAGGAACACCTTGTGTGATGCCAG
TGAGCATTTCTAAAAAGGGTGTGAGGTAGAGGTAAAAATAAGGTGAGAGACCATTTCAGAATGCACTGTTGCTC
AAAAAGGTGATCTGGTTCTTTCTTCAGAGATTTCTACGGGGATAGAAAATCGGGAGTCTGCCCTCATTAATCTG
TGACTCCACCTCTTGCATCAAATCAATATCTATTTGTTGAGCACTTATTGATTAAGACCTTGCATATGTCTGTC
CATTTTGATTTGAGATACAACTTTTTGTGTGGGTTGAATGACAAATCACTCCAAACAAAACTGGGCACAGAGAA
TCAGCTAGGAGACCAGTTATTCAGGGTCCATTTCTCTTGGATGTAAAGGAGTCCTGGGTAAAATGTGGCTGTAA
CCTAAACCAACTAGTCCTTGTGATTTGTTTCTGCCCTCTGTGTTTCCTGTTGTCAAATGCTAAGTGTGTGTTTT
GCAGTCATGAACTAAAGCACAAAAAGATGCATGAGACATTGTAGTCATATGTCTGGTGTGACACTTTGGAGCAA
AAACCTTGCAGTGGTAAATAAAAAATTTCCAACAGGGAAAAAAAAAAAAAAAAAAAAAAAAAA
```

FIGURE 63A

```
AGCGGCAGCTCCGCTGAAAACTGCATTCAGCCAGTCCTCCGGACTTCTGGAGCGGGGACAGGGCGCAGGGCATC
AGCAGCCACCAGCAGGACCTGGGAAATAGGGATTCTTCTGCCTCCACTTCAGGTTTTAGCAGCTTGGTGCTAAA
TTGCTGTCTCAAAATGCAGAGGATCTAATTTGCAGAGGAAAACAGCCAAAGAAGGAAGAGGAGGAAAAGGAAAA
AAAAAGGGGTATATTGTGGATGCTCTACTTTTCTTGGAAATGCAAAAGATTATGCATATTTCTGTCCTCCTTTC
TCCTGTTTTATGGGGACTGATTTTTGGTGTCTCTTCTAACAGCATACAGATAGGGGGGCTATTTCCTAGGGGCG
CCGATCAAGAATACAGTGCATTTCGAGTAGGGATGGTTCAGTTTTCCACTTCGGAGTTCAGACTGACACCCCAC
ATCGACAATTTGGAGGTGGCAAACAGCTTCGCAGTCACTAATGCTTTCTGCTCCCAGTTTTCGAGAGGAGTCTA
TGCTATTTTTGGATTTTATGACAAGAAGTCTGTAAATACCATCACATCATTTTGCGGAACACTCCACGTCTCCT
TCATCACTCCCAGCTTCCCAACAGATGGCACACATCCATTTGTCATTCAGATGAGACCCGACCTCAAAGGAGCT
CTCCTTAGCTTGATTGAATACTATCAATGGGACAAGTTTGCATACCTCTATGACAGTGACAGAGGCTTATCAAC
ACTGCAAGCTGTGCTGGATTCTGCTGCTGAAAAGAAATGGCAAGTGACTGCTATCAATGTGGGAAACATTAACA
ATGACAAGAAAGATGAGATGTACCGATCACTTTTTCAAGATCTGGAGTTAAAAAAGGAACGGCGTGTAATTCTG
GACTGTGAAAGGGATAAAGTAAACGACATTGTAGACCAGGTTATTACCATTGGAAAACACGTTAAAGGGTACCA
CTACATCATTGCAAATCTGGAATTTACTGATGGAGACCTATTAAAAATCCAGTTTGGAGGTGCAAATGTCTCTG
GATTTCAGATAGTGGACTATGATGATTCGTTGGTATCTAAATTTATAGAAAGATGGTCAACACTGGAAGAAAAA
GAATACCCTGGAGCTCACACAACAACAATTAAGTATACTTCTGCTCTGACCTATGATGCCGTTCAAGTGATGAC
TGAAGCCTTCCGCAACCTAAGGAAGCAAAGAATTGAAATCTCCCGAAGGGGGAATGCAGGAGACTGTCTGGCAA
ACCCAGCAGTGCCCTGGGGACAAGGTGTAGAAATAGAAAGGGCCCTCAAACAGGTTCAGGTTGAAGGTCTCTCA
GGAAATATAAAGTTTGACCAGAATGGAAAAAGAATAAACTATACAATTAACATCATGGAGCTCAAAACTAATGG
GCCCCGGAAGATTGGCTACTGGAGTGAAGTGGACAAAATGGTTGTTACCCTTACTGAGCTCCCTTCTGGAAATG
ACACCTCTGGGCTTGAGAATAAGACTGTTGTTGTCACCACAATTTTGGAATCTCCGTATGTTATGATGAAGAAA
AATCATGAAATGCTTGAAGGCAATGAGCGCTATGAGGGCTACTGTGTTGACCTGGCTGCAGAAATCGCCAAACA
TTGTGGGTTCAAGTACAAGTTGACAATTGTTGGTGATGGCAAGTATGGGGCCAGGGATGCAGACACGAAAATTT
GGAATGGGATGGTTGGAGAACTTGTATATGGGAAAGCTGATATTGCAATTGCTCCATTAACTATTACCCTTGTG
AGAGAAGAGGTGATTGACTTCTCAAAGCCCTTCATGAGCCTCGGGATATCTATCATGATCAAGAAGCCTCAGAA
GTCCAAACCAGGAGTGTTTTCCTTTCTTGATCCTTTAGCCTATGAGATCTGGATGTGCATTGTTTTTGCCTACA
TTGGGGTCAGTGTAGTTTTATTCCTGGTCAGCAGATTTAGCCCCTACGAGTGGCACACTGAGGAGTTTGAAGAT
GGAAGAGAAACACAAAGTAGTGAATCAACTAATGAATTTGGGATTTTAATAGTCTCTGGTTTTCCTTGGGTGC
CTTTATGCGGCAAGGATGCGATATTTCGCCAAGATCCCTCTCTGGGCGCATTGTTGGAGGTGTGTGGTGGTTCT
TTACCCTGATCATAATCTCCTCCTACACGGCTAACTTAGCTGCCTTCCTGACTGTAGAGAGGATGGTGTCTCCC
ATCGAAAGTGCTGAGGATCTTTCTAAGCAAACAGAAATTGCTTATGGAACATTAGACTCTGGCTCCACTAAAGA
GTTTTTCAGGAGATCTAAAATTGCAGTGTTTGATAAAATGTGGACCTACATGCGGAGTGCGGGAGCCCTCTGTGT
TTGTGAGGACTACGGCCGAAGGGGTGGCTAGAGTGCGGAAGTCCAAAGGGAAATATGCCTACTTGTTGGAGTCC
ACGATGAACGAGTACATTGAGCAAAGGAAGCCTTGCGACACCATGAAAGTTGGTGGAAACCTGGATTCCAAAGG
CTATGGCATCGCAACACCTAAAGGATCCTCATTAGGAACCCCAGTAAATCTTGCAGTATTGAAACTCAGTGAGC
AAGGCGTCTTAGACAAGCTGAAAAACAAATGGTGGTACGATAAAGGTGAATGTGGAGCCAAGGACTCTGGAAGT
AAGGAAAAGACCAGTGCCCTCAGTCTGAGCAACGTTGCTGGAGTATTCTACATCCTTGTCGGGGGCCTTGGTTT
GGCAATGCTGGTGGCTTTGATTGAGTTCTGTTACAAGTCAAGGGCCGAGGCGAAACGAATGAAGGTGGCAAAGA
ATGCACAGAATATTAACCCATCTTCCTCGCAGAATTCACAGAATTTTGCAACTTATAAGGAAGGTTACAACGTA
TATGGCATCGAAAGTGTTAAAATTTAGGGGATGACCTTGAATGATGCCATGAGGAACAAGGCAAGGCTGTCAAT
TACAGGAAGTACTGGAGAAAATGGACGTGTTATGACTCCAGAATTTCCCAAAGCAGTGCATGCTGTCCCTTACG
TGAGTCCTGGCATGGGAATGAATGTCAGTGTGACTGATCTCTCGTGATTGATAAGAACCTTTTGAGTGCCTTAC
ACAATGGTTTTCTTGTGTGTTTATTGTCAAAGTGGTGAGAGGCATCCAGTATCTTGAAGACTTTTCTTTCAGCC
AAGAATTCTTAAATATGTGGAGTTCATCTTGAATTGTAAGGAATGATTAATTAAAACACAACATCTTTTTCTAC
TCGAGTTACAGACAAAGCGTGGTGGACATGCACAGCTAACATGGAAGTACTATAATTTACCTGAAGTCTTTGTA
CAGACAACAAACCTGTTTCTGCAGCCACTATTGTTAGTCTCTTGATTCATAATGACTTAAGCACACTTGACATC
AACTGCATCAAGATGTGACATGTTTTATAAAAAAGGAAAAAAAACATTTAAAACTAAAAATATTTTTAGGTA
TTTTCACAAACAAACTGGCTTTTAAATAAATTTGCTTCCATATTGGTTGAATAAGACAAAAACAATTAAACTGA
GTGGGAAGTGAATAAAAAAAGGCTTTAGGTATCGATTCCATATTTTTCAAAGCCAAATATGTAAATGCTAAGGA
AAGTAAACAAAGAGGAGATTCCAATCTTGTAATTTAATATTGTTATTAAAACTTTAATGTATCCTATTCTTTAA
CATTTGGTGTTAATATAAAATTACTTGGCAATGCTTGACATTTGAAATAAACATTTTCTATTGTTTATTGCA
AGTGGTCCAATTAATTTTGCTTAGCTACAGTTTGGTCATAAATCAAGTGAGTTTAAAGACACTACCAAGTTGTT
AGGTGCCCAGAGAAAATTTCTCCCTTTTAAAAAGGCCAGGTGATTTTCAAATGTAATCTTGCCCCCAAAGTAA
TATCCGAATATCTTTTTGACATGTCTAAATATATATATATATAAAGAAATATTTGTTAACACAAAGCATTTGA
TCTATGTAGATAAATGCTAATAGATTTAAAAAGCTAATATTAACAAATACCAGAATACGTGAAGTTCCATTTTT
AAAGTGTTTGAGCTTACAGAAGAGAAACATTCATTTTAAATGAAGTAAAAAATGCCTTGAAAGTAATTCTTTAG
ATAGTTGCCCATTGATTAAATTCCAAAAACTAAATATGTTTTAGCTTTAAAATTATAAAAGCTGTCATAAACT
TTATATATTATGAATTTTAAAATATGTTTGAGTCTCCTGCAATATAGTTTCATCCCATTGACATCAATTAAAAA
TAACCCTAATATATTATTTTTATATTTATTCCTCAGGTGGAATGGCTATTTTAATATGCCCAGTGTGGATAAAA
TGTCACATTTCTGTAACTTTTGACTAAAGAGCCTATATTTATCTAGTTAATGAATTTAAAGGATCTATCTTTCC
CTTCATAAAATACCTCTTATTTCCATTAAAGCCCCCCAAGTTTAATTAATTTAGGATTTTGAATGATTATTGAC
```

FIGURE 63B

```
ATCCAATAGTTATTTTTAATATTTGTATTCTTGTTATTTCTGGAAGAAAGCCTTTGTGTAGCACTTGGTATTTT
GCAAAGTGCTTTTAAAACATTCTTACTTACCGTATTTCATAGAAGGGAAGGAAAAATGTAAGGTTTAACAGTAA
GCACTTGCATTGAACATGGAGGCATGTGGTATCATGATATTCTTCACTAAATTTAGCTGTCCCTAATCACAGAT
CCTAAGGTAATATAATATAATTTTAGTGCATTTCTCCTCATCAGGAATGCTGGAGGTGCATTTTAAGTTTTAAT
AATAAGTGCTAGAATGACCAAATTGCAGACTAATTGTTTCCATATTGTACTTAAAATGAGTTTTTAAAAGTGAA
AAAGAAATGACTATATACAATCAATGCTATTTATTGTACCTCTGGGCCTACTCTTCTAAAAATTGTAGCTTATC
GATTTTTCTCTGTCAAGCTTGAACTAATGTAAATAATTGAAATAATGTAAAGTTATATTTTCATGTTTTTATAG
ATACAACATGACAAGAATACATAATGTAAGAGTATTTCAACTATGGATAATGTTGATTGGATAATGCACATCTC
AGTTACAAGCAGTACTCATAGTTTAATATCCATGTAACGGTGCATCAATATATTGCTATATAAATATGTCTGTG
TGCATATAAGTGAAAAGTGGTCAAACAAGAGTGATGACAGCTGTCTAAAGGTTTTTTTATTCATTTTATATAAA
AACTGTTATGGAAAGACCAAAATGTTTATGAACTATTCTTATGTAAATTTACAATTGTCCTTTACTGTACTTTT
TTGTTTACAGTATAGTACCTTATTTTCTGCTGTGTTAAGTGGGTGTCAAACTCCAAGAAGACATACACTTTCTA
TAACTTCTATTGAAGATATTGGAATTTCCAATTTTTCATGTGTACTATGTCAGAAAATGCTTTCGATTTTATTT
TTAAATCTAACATCGGATGGCTTTTCCGGAGTGTTGTAAAAACTTCAATCATACATAAAACATGTTCTTACAAA
AGGCAAAGATCTT
```

FIGURE 64

```
GCCAACACTGGCCAAAAGGGATAGCTGTCCAAGGTCTCCCCCAGCACTGAGGAGCTCGCCTGCTGCCCTCTTGC
GCGCGGGAAGCAGCACCAAGTTCACGGCCAACGCCTTGGCACTAGGGTCCAGAATGGCTACAACAGTCCCTGAT
GGTTGCCGCAATGGCCTGAAATCCAAGTACTACAGACTTTGTGATAAGGCTGAAGCTTGGGGCATCGTCCTAGA
AACGGTGGCCACAGCCGGGGTTGTGACCTCGGTGGCCTTCATGCTCACTCTCCCGATCCTCGTCTGCAAGGTGC
AGGACTCCAACAGGCGAAAAATGCTGCCTACTCAGTTTCTCTTCCTCCTGGGTGTGTTGGGCATCTTTGGCCTC
ACCTTCGCCTTCATCATCGGACTGGACGGGAGCACAGGGCCCACACGCTTCTTCCTCTTTGGGATCCTCTTTTC
CATCTGCTTCTCCTGCCTGCTGGCTCATGCTGTCAGTCTGACCAAGCTCGTCCGGGGAGGAAGCCCCTTTCCC
TGTTGGTGATTCTGGGTCTGGCCGTGGGCTTCAGCCTAGTCCAGGATGTTATCGCTATTGAATATATTGTCCTG
ACCATGAATAGGACCAACGTCAATGTCTTTTCTGAGCTTTCCGCTCCTCGTCGCAATGAAGACTTTGTCCTCCT
GCTCACCTACGTCCTCTTCTTGATGGCGCTGACCTTCCTCATGTCCTCCTTCACCTTCTGTGGTTCCTTCACGG
GCTGGAAGAGACATGGGGCCCACATCTACCTCACGATGCTCCTCTCCATTGCCATCTGGGTGGCCTGGATCACC
CTGCTCATGCTTCCTGACTTTGACCGCAGGTGGGATGACACCATCCTCAGCTCCGCCTTGGCTGCCAATGGCTG
GGTGTTCCTGTTGGCTTATGTTAGTCCCGAGTTTTGGCTGCTCACAAAGCAACGAAACCCCATGGATTATCCTG
TTGAGGATGCTTTCTGTAAACCTCAACTCGTGAAGAAGAGCTATGGTGTGGAGAACAGAGCCTACTCTCAAGAG
GAAATCACTCAAGGTTTTGAAGAGACAGGGGACACGCTCTATGCCCCCTATTCCACACATTTTCAGCTGCAGAA
CCAGCCTCCCCAAAAGGAATTCTCCATCCCACGGGCCCACGCTTGGCCGAGCCCTTACAAAGACTATGAAGTAA
AGAAAGAGGGCAGCTAACTCTGTCCTGAAGAGTGGGACAAATGCAGCCGGGCGGCAGATCTAGCGGGAGCTCAA
AGGGATGTGGGCGAAATCTTGAGTCTTCTGAGAAAACTGTACAAGACACTACGGGAACAGTTTGCCTCCCTCCC
AGCCTCAACCACAATTCTTCCATGCTGGGGCTGATGTGGGCTAGTAAGACTCCAGTTCTTAGAGGCGCTGTAGT
ATTTTTTTTTTTTGTCTCATCCTTTAGATACTTCTTTTAAGTGGGAGTCTCAG
```

FIGURE 65

```
TCATTCCATTAAACATATTTCTAAATAATAGTAAGTGGTACTAACAAAATAAATAATAATTTAATAGCCTTAGA
AATAAATGACTGTATACTTATACAGGTTGAAAAAAACTCGGTAGGAATAAGTTACCTTTTTGTTTACTAATGTT
GGTTTCAAAAATACTCAGATTCATTTTAGTTGGCTGACATCTGGAAGTAGTTAACAACTAACCAGTGGACTTCA
ACAATCATTTGCTCCCAGGCTTCCCCCATCATCACCCTCACCACATATCCTGCTAATATCCAACAACAAACAAA
TATTTAATATTGAAATAGCCCATTGCCTGAGAATGAACACAAGCTAAAATACATGCAAGGGTACTTAATGGAAG
CCAAACCATGTTCTATACCTAAGGAGAAAACATGGACATGTAGAATGCTTTTATTCATGTATTCAAAATCAGAA
CAAATCAGTGTATATCACTAGAACATCAGATGGAGGATAACACAAGAAGTGATACAGATCAGGGTTCACTTCTC
TTACCCTCTCTCTGTTAGGACCACATTCCTATTTTAGCCAAATGTTTCTGGTACGGGCCATCTTTTCACCATAA
ATGGCATTATGTTTCAAATGGCTAAAAGCTTATTATGGGTATGCTCAAAGGAGTAAAACCCAATTCACAGAGAT
GTGGCTTTTCTAAAGAACCAAATTAAGGGAATACTTAGTATCTACAACTAAAGTATTAGTCATTCTGAGGATTA
TTTGTTGCTTTAAGTATTAGCTCCCTACTACATCCATAACACCCTACTTACTAAATTTAATTACACACAACTTT
TCAAGAATTCGTATTTTATTTGAAGGGAGGTACCTGTCTACTTTATCTACAATAAAAACAAAGGGTATTGGCTT
TCTCTAATCCATGCAAACTACAAATTCCATCGGGAGTCCTACATCACTAACAGTGGTATGAACAAAACTAAGAA
AGTACTTCCTATCCACATGTGAATGTTTTAAAAAAGTTTTTGCCATAAAACCTAAGTGTAATTTAGCATACCAC
AGTGCTCTGAAGATGGGTCATTGACGATGTACCATTTGTATATAGGTAATACACATGTAAATCACTAATTGTTA
ATTAAATATAAGAAGTAGGTTTTTATCTTTTTANNAAAAAAACAAAAAAGGTGACTCCCTTTCTCATTCTGTTC
TGTTGTATTGCGTCCAAAAGTTGTGTGTAATTTTTTTAAGGTCCAAGAAATGTAAAGAAATTTGTTGGAATACC
TGAATTTCTGTAAAAAAATAAAAATAAAAATAAGATTTTGTTACTT
```

FIGURE 66

```
GGGAGGCTGTGCCAGGCGAGCCGGAGGGGTGCTCCGCGCTCCCCCGCCCTCCTTCCGGGAGCGAGGATGCAGAC
TCTGAAACTGGTGCTGCTGGGCTGAGGCGGAGGCAGGGGAGTTGCAGCGCGCGAGGCTCCGTGAGTGTGTCTCC
TGCGCGCTGAGAGGCGGGGGGAGGCGGAGGACCAGGAGGAGGAGGAGGAGGAGGAGGGGGAGAATGCCCGG
AGCCGCCGCCGCTGCCGCCGCCGCCGCCGCGATGCTCCCGGCTCAGGAGGCTGCCAAGCTGTACCACACCA
ACTATGTGCGGAACTCGCGGGCCATCGGCGTGCTGTGGGCCATCTTCACCATCTGCTTTGCCATCGTCAACGTG
GTGTGCTTCATCCAGCCCTACTGGATAGGCGACGGCGTGGACACCCCGCAAGCCGGCTATTTCGGGCTCTTCCA
CTACTGCATCGGCAACGGCTTCTCCCGGGAGCTGACCTGCAGGGGCAGCTTCACGGACTTCTCCACGCTGCCCT
CGGGCGCCTTCAAAGCCGCCTCCTTCTTTATCGGCCTCTCCATGATGCTCATCATTGCCTGCATCATTTGCTTT
ACCCTCTTCTTCTTCTGCAACACGGCCACTGTGTACAAGATATGTGCCTGGATGCAGCTCACCTCCGCTGCCTG
CCTTGTGCTTGGCTGTATGATTTTCCCTGATGGCTGGGACTCAGATGAAGTAAAACGGATGTGTGGAGAAAAGA
CAGACAAGTACACTCTTGGGGCTTGCTCAGTCCGCTGGGCATACATCCTGGCTATTATTGGAATTTTGGATGCC
CTGATCCTCTCATTTCTAGCATTTGTGCTTGGTAATCGACAAGACAGCTTGATGGCAGAGGAACTGAAGGCAGA
AAACAAAGTTCTGCTAAGCCAATATTCTCTAGAATGAGCACAAAACAAATCGAATAACAGCTAAACAAATCGAA
TAACAGCTAAACGAATCGAATAACAGCTTTTGTACATCAACATCAAGAAGGAATACGCCTGAGAGAGATCAGAG
TATATAGATGAATATGAACAAGAATGGAACATTCACTTGTCAACGCACTTTCTAAATCTAGATCAGCAGAGATG
GGAGTGATTTTCTGGAAAGAGATGTGATCATGGATTAAACACCAGCTCATTGGAAACTCATTGGATGAGATCAG
AAAACGTTCATGAAAAATCATATTCAGGAAATAAGGAAGAGGAATATAAATGCTCTAGAGTTAACATGTAAAAT
ATATACGTACTGAGGTTTGTAAACTGTCCTTTTTAAATCAAACTGAAAACAAAAAGCTTTAACCTTTCAACAGA
ATTTTTAAAAAGGCAGTTAGTTCTAAATTATTCCTATCTCAATAGCCAAGAGGCTGATCAAGCGTCATTTATTG
AGGAAGCATCTTAGAAAATGCCTCTGAATGTTTTCATAGGAGCCGTGACCTTTGGTTCTTCATCTCTACCATTC
ATTTACTTCACTGTGTAATTAGTTACAACCACTCAGTTATTAAGAGACGTAACGCTTCAAACTTTTTACCAAGT
CTGTGTTCTGTTTAATCTGTCCATACAAGTTATTACTGAGAAAGTGTTTATGCCATATACTATTACTCCATCAA
GCTGTATATTACAGGAAGTACATCTTTACATCATAGGTTCCCAAGCAACATAGATTTCCCTATCTTTCAGGAAA
CAGCATCAAGGAACTCTGAAAAATATAGAAAAAGTTCATTTTCACCTTGGAAGCTCACGTGTAATATTATAGGC
TACTATCAAATAAACACTTTTTTTCTAATTCTCCCTAGTATATGCATAGGAATTTAATATACTTTATAAATAAG
TATCTAAAATGTCTCCTACTTTTTTCCTATTTCTTTGCCATACATGTTATCAGAAATCCATGTCTTCTATTTCC
CTTACTGATGGGCACTCATTTTTATTTTTTTAAAAATCATTCCATTAAACATATTTCTAAATAATAGTAAGTGG
TACTAACAAAATAAATAATTAATAGCCTTAGAAATAAATGACTGTATACTTATACAGGTTGAAAAAAACT
CGGTAGGAATAAGTTACCTTTTTGTTTACTAATGTTGGTTTCAAAAATACTCAGATTCATTTTAGTTGGCTGAC
ATCTGGAAGTAGTTAACAACTAACCAGTGGACTTCAACAATCATTTGCTCCCAGGCTTCCCCCATCATCACCCT
CACCACATATCCTGCTAATATCCAACAACAAACAAATATTTAATATTGAAATAGCCCATTGCCTGAGAATGAAC
ACAAGCTAAATACATGCAAGGGTACTTAATGGAAGCCAAACCATGTTCTATACCTAAGGAGAAAACATGGACA
TGTAGAATGCTTTTATTCATGTATTCAAAATCAGAACAAATCAGTGTATATCACTAGAACATCAGATGGAGGAT
AACACAAGAAGTGATACAGATCAGGGTTCACTTCTCTTACCCTCTCTCTGTTAGGACCACATTCCTATTTTAGC
CAAATGTTTCTGGTACGGGCCATCTTTTCACCATAAATGGCATTATGTTTCAAATGGCTAAAAGCATATTATGG
GTATGCTCAAAGGAGTAAAACCCAATTCACAGAGATGTGGCTTTTCTAAAGAACCAAATTAAGGGAATACTTAG
TATCTACAACTAAAGTATTAGTCATTCTGAGGATTATTTGTTGCTTTAAGTATTAGCTCCCTACTACATCCATA
ACACCCTACTTACTAAATTTAATTACACACAACTTTTCAAGAATTCGTATTTTATTTGAAGGGAGGTACCTGTC
TACTTTATCTACAATAAAAACAAAGGGTATTGGCTTTCTCTAATCCATGCAAACTACAAATTCCATCGGGAGTC
CTACATCACTAACAGTGGTATGAACAAAACTAAGAAAGTACTTCCTATCCACATGTGAATGTTTTAAAAAAGTT
TTTGCCATAAAAACCTAAGTGTAATTTAGCATACCACAGTGCTCTGAAGATGGGTCATTGACGATGTACCATTTG
TATATAGGTAATACACATGTAAATCACTAATTGTTAATTAAATATAAGAAGTAGGTTTTTATCTTTTTAAAAAA
AAAACAAAAAGGTGACTCCCTTTCTCATTCTGTTCTGTTGTATTGCGTCCAAAAGTTGTGTGTAATTTTTTTA
AGGTCCAAGAAATGTAAAGAAATTTGTTGGAATACCTGAATTTCTGTAAAAAAATAAAAATAAAAATAAGATTT
TGTTACTTAAAA
```

FIGURE 67

GGGAGGCTGTGCCAGGCGAGCCGGAGGGGTGCTCCGCGCTCCCCCGCCCTCCTTCCGGGAGCGAGGATGCAGAC
TCTGAAACTGGTGCTGCTGGGCTGAGGCGGAGGCAGGGGAGTTGCAGCGCGCGAGGCTCCGTGAGTGTGTCTCC
TGCGCGCTGAGAGGCGGGGGGAGGCGGAGGACCAGGAGGAGGAGGAGGAGGAGGAGGAGGGGGAGAATGCCCGG
AGCCGCCGCCGCTGCCGCCGCCGCCGCCGCGATGCTCCCGGCTCAGGAGGCTGCCAAGCTGTACCACACCA
ACTATGTGCGGAACTCGCGGGCCATCGGCGTGCTGTGGGCCATCTTCACCATCTGCTTTGCCATCGTCAACGTG
GTGTGCTTCATCCAGCCCTACTGGATAGGCGACGGCGTGGACACCCCGCAAGCCGGCTATTTCGGGCTCTTCCA
CTACTGCATCGGCAACGGCTTCTCCCGGGAGCTGACCTGCAGGGGCAGCTTCACGGACTTCTCCACGCTGCCCT
CGGGCGCCTTCAAAGCCGCCTCCTTCTTTATCGGCCTCTCCATGATGCTCATCATTGCCTGCATCATTTGCTTT
ACCCTCTTCTTCTTCTGCAACACGGCCACTGTGTACAAGATATGTGCCTGGATGCAGCTCACCTCCGCTGCCTG
CCTTGTGCTTGGCTGTATGATTTTCCCTGATGGCTGGGACTCAGATGAAGTAAAACGGATGTGTGGAGAAAAGA
CAGACAAGTACACTCTTGGGGCTTGCTCAGTCCGCTGGGCATACATCCTGGCTATTATTGGAATTTTGGATGCC
CTGATCCTCTCATTTCTAGCATTTGTGCTTGGTAATCGACAAGACAGCTTGATGGCAGAGGAACTGAAGGCAGA
AAACAAAGTTCTGCTAAGCCAATATTCTCTAGAATGAGCACAAAACAAATCGAATAACAGCTAAACAAATCGAA
TAACAGCTAAACGAATCGAATAACAGCTTTTGTACATCAACATCAAGAAGGAATACGCCTGAGAGAGATCAGAG
TATATAGATGAATATGAACAAGAATGGAACATTCACTTGTCAACGCACTTTCTAAATCTAGATCAGCAGAGATG
GGAGTGATTTTCTGGAAAGAGATGTGATCATGGATTAAACACCAGCTCATTGGAAACTCATTGGATGAGATCAG
AAAACGTTCATGAAAATCATATTCAGGAAATAAGGAAGAGGAATATAAATGCTCTAGAGTTAACATGTAAAT
ATATACGTACTGAGGTTTGTAAACTGTCCTTTTTAAATCAAACTGAAAACAAAAAGCTTTAACCTTTCAACAGA
ATTTTTAAAAAGGCAGTTAGTTCTAAATTATTCCTATCTCAATAGCCAAGAGGCTGATCAAGCGTCATTTATTG
AGGAAGCATCTTAGAAAATGCCTCTGAATGTTTTCATAGGAGCCGTGACCTTTGGTTCTTCATCTCTACCATTC
ATTTACTTCACTGTGTAATTAGTTACAACCACTCAGTTATTAAGAGACGTAACGCTTCAAACTTTTTACCAAGT
CTGTGTTCTGTTTAATCTGTCCATACAAGTTATTACTGAGAAAGTGTTTATGCCATATACTATTACTCCATCAA
GCTGTATATTACAGGAAGTACATCTTTACATCATAGGTTCCCAAGCAACATAGATTTCCCTATCTTTCAGGAAA
CAGCATCAAGGAACTCTGAAAAATATAGAAAAAGTTCATTTTCACCTTGGAAGCTCACGTGTAATATTATAGGC
TACTATCAAATAAACACTTTTTTTCTAATTCTCCCTAGTATATGCATAGGAATTTAATATACTTTATAAATAAG
TATCTAAAATGTCTCCTACTTTTTTCCTATTTCTTTGCCATACATGTTATCAGAAATCCATGTCTTCTATTTCC
CTTACTGATGGGCACTCATTTTTATTTTTTTAAAAATCATTCCATTAAACATATTTCTAAATAATAGTAAGTGG
TACTAACAAAATAAATAATAATTTAATAGCCTTAGAAATAAATGACTGTATACTTATACAGGTTGAAAAAAACT
CGGTAGGAATAAGTTACCTTTTTGTTTACTAATGTTGGTTTCAAAAATACTCAGATTCATTTTAGTTGGCTGAC
ATCTGGAAGTAGTTAACAACTAACCAGTGGACTTCAACAATCATTTGCTCCCAGGCTTCCCCCATCATCACCCT
CACCACATATCCTGCTAATATCCAACAACAAACAAATATTTAATATTGAAATAGCCCATTGCCTGAGAATGAAC
ACAAGCTAAATACATGCAAGGGTACTTAATGGAAGCCAAACCATGTTCTATACCTAAGGAGAAAACATGGACA
TGTAGAATGCTTTTATTCATGTATTCAAAATCAGAACAAATCAGTGTATATCACTAGAACATCAGATGGAGGAT
AACACAAGAAGTGATACAGATCAGGGTTCACTTCTCTTACCCTCTCTCTGTTAGGACCACATTCCTATTTTAGC
CAAATGTTTCTGGTACGGGCCATCTTTTCACCATAAATGGCATTATGTTTCAAATGGCTAAAAGCATATTATGG
GTATGCTCAAAGGAGTAAAACCCAATTCACAGAGATGTGGCTTTTCTAAAGAACCAAATTAAGGGAATACTTAG
TATCTACAACTAAAGTATTAGTCATTCTGAGGATTATTTGTTGCTTTAAGTATTAGCTCCCTACTACATCCATA
ACACCCTACTTACTAAATTTAATTACACACAACTTTTCAAGAATTCGTATTTTATTTGAAGGGAGGTACCTGTC
TACTTTATCTACAATAAAAACAAAGGGTATTGGCTTTCTCTAATCCATGCAAACTACAAATTCCATCGGGAGTC
CTACATCACTAACAGTGGTATGAACAAAACTAAGAAAGTACTTCCTATCCACATGTGAATGTTTTAAAAAAGTT
TTTGCCATAAAACCTAAGTGTAATTTAGCATACCACAGTGCTCTGAAGATGGGTCATTGACGATGTACCATTTG
TATATAGGTAATACACATGTAAATCACTAATTGTTAATTAAATATAAGAAGTAGGTTTTATCTTTTTAAAAAA
AAAACAAAAAAGGTGACTCCCTTTCTCATTCTGTTCTGTTGTATTGCGTCCAAAAGTTGTGTGTAATTTTTTA
AGGTCCAAGAAATGTAAAGAAATTTGTTGGAATACCTGAATTTCTGTAAAAAAATAAAAATAAAAATAAGATTT
TGTTACTTAAAA

FIGURE 68

```
GGGAGGCTGTGCCAGGCGAGCCGGAGGGGTGCTCCGCGCTCCCCCGCCCTCCTTCCGGGAGCGAGGATGCAGAC
TCTGAAACTGGTGCTGCTGGGCTGAGGCGGAGGCAGGGGAGTTGCAGCGCGCGAGGCTCCGTGAGTGTGTCTCC
TGCGCGCTGAGAGGCGGGGGGAGGCGGAGGACCAGGAGGAGGAGGAGGAGGAGGAGGGGGAGAATGCCCGG
AGCCGCCGCCGCTGCCGCCGCCGCCGCCGCCGCGATGCTCCCGGCTCAGGAGGCTGCCAAGCTGTACCACACCA
ACTATGTGCGGAACTCGCGGGCCATCGGCGTGCTGTGGGCCATCTTCACCATCTGCTTTGCCATCGTCAACGTG
GTGTGCTTCATCCAGCCCTACTGGATAGGCGACGGCGTGGACACCCCGCAAGCCGGCTATTTCGGGCTCTTCCA
CTACTGCATCGGCAACGGCTTCTCCCGGGAGCTGACCTGCAGGGGCAGCTTCACGGACTTCTCCACGCTGCCCT
CGGGCGCCTTCAAAGCCGCCTCCTTCTTTATCGGCCTCTCCATGATGCTCATCATTGCCTGCATCATTTGCTTT
ACCCTCTTCTTCTTCTGCAACACGGCCACTGTGTACAAGATATGTGCCTGGATGCAGCTCACCTCCGCTGCCTG
CCTTGTGCTTGGCTGTATGATTTTCCCTGATGGCTGGGACTCAGATGAAGTAAAACGGATGTGTGGAGAAAAGA
CAGACAAGTACACTCTTGGGGCTTGCTCAGTCCGCTGGGCATACATCCTGGCTATTATTGGAATTTTGGATGCC
CTGATCCTCTCATTTCTAGCATTTGTGCTTGGTAATCGACAAGACAGCTTGATGGCAGAGGAACTGAAGGCAGA
AAACAAAGTTCTGCTAAGCCAATATTCTCTAGAATGAGCACAAAACAAATCGAATAACAGCTAAACAAATCGAA
TAACAGCTAAACGAATCGAATAACAGCTTTTGTACATCAACATCAAGAAGGAATACGCCTGAGAGAGATCAGAG
TATATAGATGAATATGAACAAGAATGGAACATTCACTTGTCAACGCACTTTCTAAATCTAGATCAGCAGAGATG
GGAGTGATTTTCTGGAAAGAGATGTGATCATGGATTAAACACCAGCTCATTGGAAACTCATTGGATGAGATCAG
AAAACGTTCATGAAAATCATATTCAGGAAATAAGGAAGAGGAATATAAATGCTCTAGAGTTAACATGTAAAT
ATATACGTACTGAGGTTTGTAAACTGTCCTTTTTAAATCAAACTGAAAACAAAAAGCTTTAACCTTTCAACAGA
ATTTTTAAAAAGGCAGTTAGTTCTAAATTATTCCTATCTCAATAGCCAAGAGGCTGATCAAGCGTCATTTATTG
AGGAAGCATCTTAGAAAATGCCTCTGAATGTTTTCATAGGAGCCGTGACCTTTGGTTCTTCATCTCTACCATTC
ATTTACTTCACTGTGTAATTAGTTACAACCACTCAGTTATTAAGAGACGTAACGCTTCAAACTTTTTACCAAGT
CTGTGTTCTGTTTAATCTGTCCATACAAGTTATTACTGAGAAAGTGTTTATGCCATATACTATTACTCCATCAA
GCTGTATATTACAGGAAGTACATCTTTACATCATAGGTTCCCAAGCAACATAGATTTCCCTATCTTTCAGGAAA
CAGCATCAAGGAACTCTGAAAAATATAGAAAAAGTTCATTTTCACCTTGGAAGCTCACGTGTAATATTATAGGC
TACTATCAAATAAACACTTTTTTTCTAATTCTCCCTAGTATATGCATAGGAATTTAATATACTTTATAAATAAG
TATCTAAAATGTCTCCTACTTTTTTCCTATTTCTTTGCCATACATGTTATCAGAATCCATGTCTTCTATTTCC
CTTACTGATGGGCACTCATTTTTATTTTTTTAAAAATCATTCCATTAAACATATTTCTAAATAATAGTAAGTGG
TACTAACAAAATAAATAATAATTTAATAGCCTTAGAAATAAATGACTGTATACTTATACAGGTTGAAAAAAACT
CGGTAGGAATAAGTTACCTTTTTGTTTACTAATGTTGGTTTCAAAAATACTCAGATTCATTTTAGTTGGCTGAC
ATCTGGAAGTAGTTAACAACTAACCAGTGGACTTCAACAATCATTTGCTCCCAGGCTTCCCCCATCATCACCCT
CACCACATATCCTGCTAATATCCAACAACAAACAAATATTTAATATTGAAATAGCCCATTGCCTGAGAATGAAC
ACAAGCTAAAATACATGCAAGGGTACTTAATGGAAGCCAAACCATGTTCTATACCTAAGGAGAAAACATGGACA
TGTAGAATGCTTTTATTCATGTATTCAAATCAGAACAAATCAGTGTATATCACTAGAACATCAGATGGAGGAT
AACACAAGAAGTGATACAGATCAGGGTTCACTTCTCTTACCCTCTCTCTGTTAGGACCACATTCCTATTTAGC
CAAATGTTTCTGGTACGGGCCATCTTTTCACCATAAATGGCATTATGTTTCAAATGGCTAAAAGCATATTATGG
GTATGCTCAAAGGAGTAAAACCCAATTCACAGAGATGTGGCTTTTCTAAAGAACCAAATTAAGGGAATACTTAG
TATCTACAACTAAAGTATTAGTCATTCTGAGGATTATTTGTTGCTTTAAGTATTAGCTCCCTACTACATCCATA
ACACCCTACTTACTAAATTTAATTACACACAACTTTTCAAGAATTCGTATTTTATTTGAAGGGAGGTACCTGTC
TACTTTATCTACAATAAAAACAAAGGGTATTGGCTTTCTCTAATCCATGCAAACTACAAATTCCATCGGGAGTC
CTACATCACTAACAGTGGTATGAACAAAACTAAGAAAGTACTTCCTATCCACATGTGAATGTTTTAAAAAAGTT
TTTGCCATAAAACCTAAGTGTAATTTAGCATACCACAGTGCTCTGAAGATGGGTCATTGACGATGTACCATTTG
TATATAGGTAATACACATGTAAATCACTAATTGTTAATTAAATATAAGAAGTAGGTTTTTATCTTTTTAAAAAA
AAAACAAAAAGGTGACTCCCTTTCTCATTCTGTTCTGTTGTATTGCGTCCAAAAGTTGTGTGTAATTTTTTTA
AGGTCCAAGAAATGTAAAGAAATTTGTTGGAATACCTGAATTTCTGTAAAAAAATAAAAATAAAAATAAGATTT
TGTTACTTAAAA
```

FIGURE 69

```
CAGGCCTCTGAGGCTCCCTTGCCGAGGGCCCCGAGCTGCAGGGACAGTGAGCAGTGAGTCCCTTGGGCATCCCG
CTCCTGGGCAGGTCACCAATAGGTCCCCGCAGTTCCCAATGGAACTGTTCCAGTCCTCCCCGAGGCCTCCACTT
CAACCTGTCTGTGTCTGCCCAGGCCTGGAGTTGTGTGACCCTCCCCACCGCCTGGCCTTCTCCATGGGGCTGG
CCTTTTCTCGGTGGTGGGCACCCTGCTGCTGCCCGGCCTGGCTGCGCTTGTGCAGGACTGGCGTCTTCTGCAGG
GGCTGGGTGCCCTGATGAGTGGACTCTTGCTGCTCTTTTGGGGGTTCCCGGCCCTGTTCCCCGAGTCTCCCTGC
TGGCTGCTGGCCACAGGTCAGGTAGCTCGAGCCAGGAAGATCCTGTGGCGCTTTGCAGAAGCCAGTGGCGTGGG
CCCCGGGGACAGTTCCTTGGAGGAGAACTCCCTGGCTACAGAGCTGACCATGCTGTCTGCACGGAGCCCCCAGC
CCCGGTACCACTCCCCACTGGGGCTTCTGCGTACCCGAGTCACCTGGAGAAACGGGCTTATCTTGGGCTTCAGC
TCGCTGGTTGGTGGAGGCATCAGAGCTAGCTTCCGCCGCAGCCTGGCACCTCAGGTGCCGACCTTCTACCTGCC
CTACTTCCTGGAGGCCGGCCTGGAGGCGGCAGCCTTGGTCTTCCTGCTCCTGACGGCAGATTGCTGTGGACGCC
GCCCCGTGCTGCTGCTGGGCACCATGGTCACAGGCCTGGCATCCCTGCTGCTCCTCGCTGGGGCCCAGTATCTG
CCAGGCTGGACTGTGCTGTTCCTCTCTGTCCTGGGGCTCCTGGCCTCCGGGCTGTGTCCGCACTCAGCAGCCT
CTTCGCGGCCGAGGTCTTCCCCACGGTGATCAGGGGGGCCGGGCTGGGCCTGGTGCTGGGGGCCGGGTTCCTGG
GCCAGGCAGCCGGCCCCCTGGACACCCTGCACGGCCGGCAGGGCTTCTTCCTGCAACAAGTCGTCTTCGCCTCC
CTTGCTGTCCTTGCCCTGCTGTGTGTCCTGCTGCTGCCTGAGAGCCGAAGCCGGGGGCTGCCCCAGTCACTGCA
GGACGCCGACCGCCTGCGCCGCTCCCCACTCCTGCGGGGCCGCCCCCGCCAGGACCACCTGCCTCTGCTGCCGC
CCTCCAACTCCTACTGGGCCGGCCACACCCCCGAGCAGCACTAGTCCTGCCTGGTGGCCCTGGGAGCCAGGATG
GGACCAAAGTCAAGGCCTGGGGCATGGCTGAGTACCCCAGACGTCTGGTCCAGGGCAGACACATTCCTCTCAGA
AGCCCGTGTCTCAGTGCAGGTGGAGCCGTGGGGACAGCGTGAAGGTGTCTCCAGCCAGGCCCCAGGCACTGGGA
GGCCCTGGGTCTCCCCCCAGCCACACCCAGTAGGTGTGGAGGATAAAGGCTTCTGTGGAACTTGGCGTCCTCCC
TGGTTCTTCCCTCAGGCCACACCTGGGGCCTGGAAGGGTCTCACCTGTGCCTGCTCCCCACCTCTGGGCTCACC
AGCAAGGAGCCAGGGTGTCAGCGGCTGCTCCATAGCCCCTGTCCAGGTAGTGGCAGCCCCCGGCCGCCTCCTGC
CCCAGCCAAGCAGGGTGGTATGGGGGCCTGGCCCTCAGGTCCCTGCCAGGCCAGGCCTCACTGGCCCCATCCCC
CTCATGGTCAGTGTGGCAGTGGGCGCCCGTCCTGCATGAAAGAGACTAGCACG
```

FIGURE 70

```
AGCGGGGCGGGTCCCCGAAGCCCAGTACCAGACCTCCTGTGCGAAGAGTAACCTGCTCTTCGGACTGATAACTG
GATGGAATGGCCTTTAGAAAGGGAGCATCTTCAGAATCTGCAGCTGGGATCAGATTGTTCTTTTGTTGAATCAA
CTCAGCTCTGCCGAGCCAGCATCTTGCTAAGGGTTACAAAATAAATGCCATTTGAACAGTGCCATCTGTCATGG
AAAAACGTGAGACGTTTGTACAATGCCGTGTCTAAGGAGCTGGTTGGAGAGTTTTTGCAATTTGTTCAACTTGA
TAAAGAGGCCTCTGATCCTTTCAGCCTAAATGAATTACTAGATGAATTATCAAGGAAACAGAAAGAAGAATTAT
GGCAAAGGCTGAAGAATTTATTGACAGATGTGTTGTTAGAAAGCCCAGTGGATGGGTGGCAGGTAGTGGAAGCC
CAGGGTGAAGACAATATGGAAACCGAACATGGCTCAAAAATGAGAAAAAGCATAGAAATAATTTATGCAATTAC
ATCTGTGATTCTTGCTTCTGTGTCTGTAATAAATGAAAGTGAGAACTACGAAGCCCTACTGGAATGTGTTATTA
TATTAAATGGTATTTTATATGCATTACCTGAGTCTGAACGAAAACTACAGAGTTCTATTCAGGATTTGTGTGTT
ACCTGGTGGGAGAAAGGCCTGCCTGCCAAGGAAGACACAGGAAAGACAGCCTTTGTCATGTTACTAAGGAGGAG
TCTGGAGACTAAGACAGGTGCAGACGTATGTCGGCTTTGGCGTATCCATCAAGCTTTATATTGCTTTGATTATG
ATTTGGAGGAAAGTGGAGAAATTAAAGATATGTTACTTGAGTGCTTCATAAATATTAATTATATCAAGAAAGAA
GAGGGAAGAAGATTTCTTAGTTGTCTCTTCAACTGGAATATCAACTTCATCAAAATGATCCACGGGACCATTAA
AAACCAGTTACAGGGATTACAAAAGTCTTTGATGGTATACATTGCAGAAATTTATTTCAGAGCTTGGAAAAAGG
CTTCAGGGAAAATACTGGAGGCGATTGAAAATGATTGCATCCAGGACTTCATGTTCCACGGGATACACCTTCCG
AGGAGGTCTCCAGTGCATTCCAAAGTGCGGGAGGTTCTGAGTTACTTTCACCATCAAAAGAAAGTTCGGCAGGG
AGTGGAAGAGATGCTTTATAGATTATATAAGCCCATCCTTTGGAGAGGATTAAAGGCCAGAAACTCTGAAGTTC
GATCAAATGCTGCATTGTTGTTTGTTGAAGCATTTCCTATTAGGGATCCAAACCTTCATGCTATTGAAATGGAT
AGTRAAATCCAGAAACAGTTTGAAGAGCTCTATAGCCTTTTAGAAGATCCTTACCCGATGGTCCGTTCCACAGG
GATCCTTGGTGTTTGTAAAATAACTTCTAAGTACTGGGAAATGATGCCCCCGACCATTCTTATTGACCTCCTGA
AGAAGGTGACTGGGGAACTGGCATTTGACACGAGCTCAGCTGATGTTCGTTGTTCTGTCTTTAAGTGTCTGCCA
ATGATTTTGGACAACAAACTGAGCCACCCATTGTTAGAGCAGCTCCTTCCAGCTCTCAGATACAGTCTCCACGA
CAATTCGGAGAAAGTGAGGGTAGCTTTTGTGGACATGCTGTTGAAGATCAAAGCTGTGAGGGCTGCTAAGTTTT
GGAAAATATGTCCCATGGAGCACATTCTGGTTCGTCTGGAAACTGATTCTCGACCTGTGTCTCGGCGCCTGGTG
AGCCTCATCTTTAATTCTTTCCTGCCTGTGAATCAGCCGGAGGAGGTCTGGTGCGAGCGCTGTGTCACCCTGGT
GCAGATGAACCACGCCGCTGCCAGGAGGTTCTATCAGTACGCCACGAACACACCGCCTGCACCAACATAGCAA
AGCTGATTCACGTTATTCGTCATTGCTTAAATGCCTGTATCCAGAGGGCAGTGAGAGAGCCTCCAGAGGACGAG
GAGGAAGAGGACGGAAGGGAGAAGGAGAATGTGACTGTTCTGGACAAAACACTGTCAGTAAACGATGTTGCATG
CATGGCAGGTTTACTAGAAATCATTGTGATTCTCTGGAAAAGTATTGACAGAAGTATGGAAAATAATAAAGAGG
CCAAACTTTACACGATTAACAAGTTTGCCTCTGTGCTTCCAGAGTATCTGAAAGTATTTAAGGATGATCGCTGC
AAGATCCCTTTATTCATGCTAATGTCCTTTATGCCGGCCTCTGCTGTCCCCCCATTCAGCTGTGGTGTGATTTC
CACGCTGAGAAGCCGGGAGGAGGGCGCTGTGGACAAGAGCTACTGCACTTTGTTGGATTGCCTCTGCTCCTGGG
GGCAGGTGGGGCACATTCTGGAGCTTGTTGACAACTGGCTGCCCACAGAGCATGCCCAGGCCAAGAGCAACACA
GCTTCTAAAGGTAGGGTGCAGATCCATGACACACGCCCAGTCAAACCTGAATTGGCATTGGTCTACATTGAGTA
TCTGCTGACTCATCCAAAGAACCGCGAGTGCTTGCTCTCTGCTCCTCGGAAGAAACTTAACCATCTTTTGAAAG
CCCTTGAAACGTCAAAGGCAGATCTGGAGTCACTTCTGCAGACACCGGGTGGGAAGCCTCGTGGCTTCAGTGAA
GCAGCTGCCCCGCGAGCCTTTGGTCTCCACTGTCGCCTGAGCATCCATCTTCAGCACAAGTTCTGCTCAGAAGG
AAAGGTGTATTTGTCCATGTTGGAAGACACTGGCTTTTGGTTAGAAAGCAAAATTTTATCTTTTATTCAAGATC
AAGAAGAAGACTACCTGAAGCTTCATAGGGTCATTTATCAGCAAATTATCCAGACCTACCTGACTGTGTGTAAA
GATGTTGTTATGGTAGGCCTTGGTGACCATCAGTTTCAGATGCAACTCTTACAGCGGAGTCTTGGAATCATGCA
AACAGTGAAGGGATTTTTTATGTTTCATTACTTCTTGACATTCTGAAAGAGATAACTGGAAGTTCCTTGATTC
AGAAAACAGATTCAGATGAAGAAGTTGCAATGCTGTTGGACACAGTCCAGAAAGTATTTCAGAAAATGTTGGAA
TGTATTGCACGGAGCTTCAGGAAGCAGCCGGAAGAAGGCCTGGCTGCTTTATTCTGTTCAGAGGCCTCTTCA
TGAGTTCATTACTGCTGTTCAGTCTGCGCACACAGACACCCCTGTGCACCGGGGTGTACTTTCTACTCTGATCG
CTGGGCCTGTGGTTGAGATAAGTCACCAGCTACGGAAGGTTTCTGACGTAGAAGAGCTTACCCCTCCAGAGCAT
CTTTCTGATCTTCCACCATTTTCAAGGTGTTTAATAGGAATAATAATAAAGTCTTCGAATGTGGTCAGGTCATT
TTTGGATGAATTAAAGGCATGTGTGGCTTCTAATGATATTGAAGGCATTGTGTGCCTCACGGCTGCTGTGCATA
TTATCCTGGTTATTAATGCAGGTAAACATAAAAGCTCAAAGTGAGGGAGGTTGCAGCCACTGTTCACAGAAAA
CTAAAGACATTCATGGAAATTACTTTGGAAGAGGATAGCATTGAAAGATTTCTCTATGAATCATCATCAAGAAC
TCTGGGAGAACTTTTGAATTCATAACCAAGCCAACATCTCCAGACATGTAAAAATAGGGAAAAGTGATTCAAAT
TGAAATGCCTGTGTATTTTCCTATTGTTTTAATGTTAATAACCCATATAATAGGGAAAGGGTGGGATTTTTTT
GTGGGAATGTGGGAAGGTGGGGGTTATGGAGGAGATAACTCAAAACTTCTTCAATTTTGCCTAGTGCCTGCGTA
AATAATATATTTAATATAAAGGACTCCAGGTATGAATGGTGTAGAAATCCATGATTCCAAGAAAAAACACTTTT
CTAGCAAACCTGGTTGTTTTAAAATGACTTTTATATATGTAATATTGCTTGGAAACTATGAGTAATAAAGCAA
TGACAACAAMAAAAAAAAAAAAAAAA
```

FIGURE 71

```
GCCCTTCAGAATCTGCAGCTGGGATCAGATTGTTCTTTTGTTGAATCAACTCAGCTCTGCCGAGCCAGCATCTT
GCTAAGGGTTACAAAATAAATGCCATTTGAACAGTGCCATCTGTCATGGAAAAACGTGAGACGTTTGTACAAGC
CGTGTCTAAGGAGCTGGTTGGAGAGTTTTTGCAATTTGTTCAACTTGATAAAGAGGCCTCTGATCCTTTCAGCC
TAAATGAATTACTAGATGAATTATCAAGGAAACAGAAGAAGAATTATGGCAAAGGCTGAAGAATTTATTGACA
GATGTGTTGTTAGAAAGCCCAGTGGATGGGTGGCAGGTAGTGGAAGCCCAGGGTGAAGACAATATGGAAACCGA
ACATGGCTCAAAAATGAGAAAAAGCATAGAAATAATTTATGCAATTACATCTGTGATTCTTGCTTCTGTGTCTG
TAATAAATGAAAGTGAGAACTACGAAGCCCTACTGGAATGTGTTATTATATTAAATGGTATTTTATATGCATTA
CCTGAGTCTGAACGAAAACTACAGAGTTCTATTCAGGATTTGTGTGTTACCTGGTGGGAGAAAGGCCTGCCTGC
CAAGGAAGACACAGGAAAGACAGCCTTTGTCATGTTACTAAGGAGGAGTCTGGAGACTAAGACAGGTGCAGACG
TATGTCGGCTTTGGCGTATCCATCAAGCTTTATATTGCTTTGATTATGATTTGGAGGAAAGTGGAGAAATTAAA
GATATGTTACTTGAGTGCTTCATAAATATTAATTATATCAAGAAAGAAGAGGGAAGAAGATTTCTTAGTTGTCT
CTTCAACTGGAATATCAACTTCATCAAAATGATCCACGGGACCATTAAAAACCAGTTACAGGGATTACAAAAGT
CTTTGATGGTATACATTGCAGAAATTTATTTCAGAGCTTGGAAAAAGGCTTCAGGGAAAATACTGGAGGCGATT
GAAAATGATTGCATCCAGGACTTCATGTTCCACGGGATACACCTTCCGAGGAGGTCTCCAGTGCATTCCAAAGT
GCGGGAGGTTCTGAGTTACTTTCACCATCAAAAGAAAGTTCGGCAGGGAGTGGAAGAGATGCTTTATAGATTAT
ATAAGCCCATCCTTTGGAGAGGATTAAAGGCCAGAAACTCTGAAGTTCGATCAAATGCTGCATTGTTGTTTGTT
GAAGCATTTCCTATTAGGGATCCAAACCTTCATGCTATTGAAATGGATAGTGAAATCCAGAAACAGTTTGAAGA
GCTCTATAGCCTTTTAGAAGATCCTTACCCGATGGTCCGTTCCACAGGGATCCTTGGTGTTTGTAAAATAACTT
CTAAGTACTGGGAAATGATGCCCCGACCATTCTTATTGACCTCCTGAAGAAGGTGACTGGGGAACTGGCATTT
GACACGAGCTCAGCTGATGTTCGTTGTTCTGTCTTTAAGTGTCTGCCAATGATTTTGGACAACAAACTGAGCCA
CCCATTGTTAGAGCAGCTCCTTCCAGCTCTCAGATACAGTCTCCACGACAATTCGGAGAAAGTGAGGGTAGCTT
TTGTGGACATGCTGTTGAAGATCAAAGCTGTGAGGGCTGCTAAGTTTTGGAAAATATGTCCCATGGAGCACATT
CTGGTTCGTCTGGAAACTGATTCTCGACCTGTGTCTCGGCGCCTGGTGAGCCTCATCTTTAATTCTTTCCTGCC
TGTGAATCAGCCGGAGGAGGTCTGGTGCGAGCGCTGTGTCACCCTGGTGCAGATGAACCACGCCGCTGCCAGGA
GGTTCTATCAGTACGCCCACGAACACACCGCCTGCACCAACATAGCAAAGCTGATTCACGTTATTCGTCATTGC
TTAAATGCCTGTATCCAGAGGGCAGTGAGAGAGCCTCCAGAGGACGAGGAGGAAGAGGACGGAAGGGAGAAGGA
GAATGTGACTGTTCTGGACAAAACACTGTCAGTAAACGATGTTGCATGCATGGCAGGTTTACTAGAAATCATTG
TGATTCTCTGGAAAAGTATTGACAGAATGTATGGAAAATAATAAAGAGGCCAAACTTTACACGATTAACAAGTTT
GCCTCTGTGCTTCCAGAGTATCTGAAAGTATTTAAGGATGATCGCTGCAAGATCCCTTTATTCATGCTAATGTC
CTTTATGCCGGCCTCTGCTGTCCCCCCATTCAGCTGTGGTGTGATTTCCACGCTGAGAAGCCGGGAGGAGGGCG
CTGTGGACAAGAGCTACTGCACTTTGTTGGATTGCCTCTGCTCCTGGGGCAGGTGGGGCACATTCTGGAGCTT
GTTGACAACTGGCTGCCCACAGAGCATGCCCAGGCCAAGAGCAACACAGCTTCTAAAGGTAGGGTGCAGATCCA
TGACACACGCCCAGTCAAACCTGAATTGGCATTGGTCTACATTGAGTATCTGCTGACTCATCCAAAGAACCGCG
AGTGCTTGCTCTCTGCTCCTCGGAAGAAACTTAACCATCTTTTGAAAGCCCTTGAAACGTCAAAGGCAGATCTG
GAGTCACTTCTGCAGACACCGGGTGGGAAGCCTCGTGGCTTCAGTGAAGCAGCTGCCCCGCGAGCCTTTGGTCT
CCACTGTCGCCTGAGCATCCATCTTCAGCACAAGTTCTGCTCAGAAGGAAAGGTGTATTTGTCCATGTTGGAAG
ACACTGGCTTTTGGTTAGAAAGCAAAATTTTATCTTTTATTCAAGATCAAGAAGAAGACTACCTGAAGCTTCAT
AGGGTCATTTATCAGCAAATTATCCAGACCTACCTGACTGTGTGTAAAGATGTTGTTATGGTAGGCCTTGGTGA
CCATCAGTTTCAGATGCAACTCTTACAGCGGAGTCTTGGAATCATGCAAACAGTGAAGGGATTTTTTTATGTTT
CATTACTTCTTGACATTCTGAAAGAGATAACTGGAAGTTCCTTGATTCAGAAAACAGATTCAGATGAAGAAGTT
GCAATGCTGTTGGACACAGTCCAGAAAGTATTTCAGAAAATGTTGGAATGTATTGCACGGAGCTTCAGGAAGCA
GCCGGAAGAAGGCCTGCGGCTGCTTTATTCTGTTCAGAGGCCTCTTCATGAGTTCATTACTGCTGTTCAGTCTC
GGCACACAGACACCCCTGTGCACCGGGGTGTACTTTCTACTCTGATCGCTGGGCCTGTGGTTGAGATAAGTCAC
CAGCTACGGAAGGTTTCTGACGTAGAAGAGCTTACCCCTCCAGAGCATCTTTCTGATCTTCCACCATTTTCAAG
GTGTTTAATAGGAATAATAATAAAGTCTTCGAATGTGGTCAGGTCATTTTTGGATGAATTAAAGGCATGTGTGG
CTTCTAATGATATTGAAGGCATTGTGTGCCTCACGGCTGCTGTGCATATTATCCTGGTTATTAATGCAGGTAAA
CATAAAAGCTCAAAAGTGAGGGAGGTTGCAGCCACTGTTCACAGAAAACTAAAGACATTCATGGAAATTACTTT
GGAAGAGGATAGCATTGAAAGATTTCTCTATGAATCATCATCAAGAACTCTGGGAGAACTTTTGAATTCATAAC
CAAGCCAACATCTCCAGACATGAAGGGC
```

FIGURE 72

```
TCCAACCAGATTTTCACCGCTATGCCTCCTTTCACTCTGGGAGTCTTCCAGAGGTCTTGCACTCGGGAGAGCAT
GCTCAGGTTTCCCCAGCTCTACAAAATCACCCAGAATGCCAAAGACTTCAACGTGACCAGTGGTCATGCCACTG
CCTGTTGATTTGTTGAAAATATTGTTTACACGTATGTTCTTGTTACTGATTGTCAGAAAGCTGGTTTTGAGACT
GCAGCTTGGACTAAATTCAGTCATCTGGCTGTCTGGGGAAGCATGCTGACCAGTCTGGTGTTCTTTGGCATCTA
CTCAGCCATCTGGTCCACCATTCTCATTGCCCCAAATATGAGAGGACAGAAGAATGGTACCGGTACTGCCAATG
GAGATGGAGGAAGGAGACAGAAAGAAACAGAGCCCAGACCCTAGGGACCACCAGCATTTGCAGAATGGATAAAC
AGCCTTCTTCCTAACAAAGGAAGCACAGCAACTGTGATCCTGAGCTGTGCACACTTCTGGTTGGGATTATTTCT
GGTTTCTACTTCCTGTTTGAAGATGTGGCATGGAGAGTGAACAAGCTGCTGCCCACCACCTGGCATCACAGCCC
CAGAACTCAGCTATTTCCATGGACCACAGCATCTCATCTCTGGGCTGAGCCAGAAAGACCCCTACTGAAGTCC
AGAGGCACTTTTCTGAAAGGCTCTGCTTTGACCTGAAGTATTTTATCTATCCTCAGTCTCAGGACACTGTTGAT
GGAATTAAGGCCAAGCACATCTGCAAAAAAGACATTGCTGGAGGAGGTGCAAAGAGCTGGAAACCAAGTCTCCA
GTCCTGGGAAAAGCAGTGGTATGGAAAAGCAATGGAAAGAGCATTTTGAAAATGCCATTCCACTGTTTTCTGGC
CTTTATGATTTCTGCTGAGAAATCCACTGTTAGTCTGATGGGGTCTCCTTCATAGCACCAATGACCTGAAGAGC
CTTGTTGAAGGAAGACTCCATCTGATGACTCAGAGCAAGTATTTTTTAGTGTGTTATTGTTATTAGCAGAAAGA
GGGCCATAAAATACATGGGGCAAGCTGAATATATCTTAGGCAAAAGAAGAAAATATTCAAATTCTTATGTTATT
TTATCTAATTATTTTATCTCTTTTTGTGTGTGACTTATAATGTGTGTATTGTATTAATAAAAGTATATAAACAT
GTAGTTT
```

FIGURE 73

CATTCCCACCCTTCCTTCTTTAATAAGCAGGAGCGAAAAAGACAAATTCCAAAGAGGATTGTTCAGTTCAAGGG
AATGAAGAATTCAGAATAATTTTGGTAAATGGATTCCAATATCGGGAATAAGAATAAGCTGAACAGTTGACCTG
CTTTGAAGAAACATACTGTCCATTTGTCTAAAATAATCTATAACAACCAAACCAATCAAAATGAATTCAACATT
ATTTTCCCAGGTTGAAAATCATTCAGTCCACTCTAATTTCTCAGAGAAGAATGCCCAGCTTCTGGCTTTTGAAA
ATGATGATTGTCATCTGCCCTTGGCCATGATATTTACCTTAGCTCTTGCTTATGGAGCTGTGATCATTCTTGGT
GTCTCTGGAAACCTGGCCTTGATCATAATCATCTTGAAACAAAAGGAGATGAGAAATGTTACCAACATCCTGAT
TGTGAACCTTTCCTTCTCAGACTTGCTTGTTGCCATCATGTGTCTCCCCTTTACATTTGTCTACACATTAATGG
ACCACTGGGTCTTTGGTGAGGCGATGTGTAAGTTGAATCCTTTTGTGCAATGTGTTTCAATCACTGTGTCCATT
TTCTCTCTGGTTCTCATTGCTGTGGAACGACATCAGCTGATAATCAACCCTCGAGGGTGGAGACCAAATAATAG
ACATGCTTATGTAGGTATTGCTGTGATTTGGGTCCTTGCTGTGGCTTCTTCTTTGCCTTTCCTGATCTACCAAG
TAATGACTGATGAGCCGTTCCAAAATGTAACACTTGATGCGTACAAAGACAAATACGTGTGCTTTGATCAATTT
CCATCGGACTCTCATAGGTTGTCTTATACCACTCTCCTCTTGGTGCTGCAGTATTTTGGTCCACTTTGTTTTAT
ATTTATTTGCTACTTCAAGATATATATACGCCTAAAAAGGAGAAACAACATGATGGACAAGATGAGAGACAATA
AGTACAGGTCCAGTGAAACCAAAAGAATCAATATCATGCTGCTCTCCATTGTGGTAGCATTTGCAGTCTGCTGG
CTCCCTCTTACCATCTTTAACACTGTGTTTGATTGGAATCATCAGATCATTGCTACCTGCAACCACAATCTGTT
ATTCCTGCTCTGCCACCTCACAGCAATGATATCCACTTGTGTCAACCCCATATTTTATGGGTTCCTGAACAAAA
ACTTCCAGAGAGACTTGCAGTTCTTCTTCAACTTTTGTGATTTCCGGTCTCGGGATGATGATTATGAAACAATA
GCCATGTCCACGATGCACACAGATGTTTCCAAAACTTCTTTGAAGCAAGCAAGCCCAGTCGCATTTAAAAAAAT
CAACAACAATGATGATAATGAAAAAATCTGAAACTACTTATAGCCTATGGTCCCGGATGACATCTGTTTAAAAA
CAAGCACAACCTGCAACATACTTTGATTACCTGTTCTCCCAAGGAATGGGGTTGAAATCATTTGAAAATGACTA
AGATTTTCTTGTCTTGCTTTTTACTGCTTTTGTTGTAGTTGTCATAATTACATTTGGAACAAAAGGTGTGGGCT
TTGGGGTCTTCTGGAAATAGTTTTGACCAGACATCTTTGAAGTGCTTTTTGTGAATTTATGCATATAATATAAA
GACTTTTATACTGTACTTATTGGAATGAAATTTCTTTAAAGTATTACGATGCGCTGACTTCAGAAGTACCTGCC
ATCCAATACGGTCATTAGATTGGGTCATCTTGATTAGATTAGATTAGATTAGATTGTCAACAGATTGGCCATC
CTTACTTTATGATAGGCATCATTTTAGTGTGTTACAATAGTAACAGTATGCAAAAGCAGCATTCAGGAGCCGAA
AGATAGTCTTGAAGTCATTCAGAAGTGGTTTGAGGTTTCTGTTTTTGGTGGTTTTTGTTTGTTTTTTTTTTT
TTCACCTTAAGGGAGGCTTTCATTTCCTCCCGACTGATTGTCACTTAAATCAAAATTTAAAAATGAATAAAAAG
ACATACTTCTCAGCTGCAAATATTATGGAGAATTGGGCACCCACAGGAATGAAGAGAGAAAGCAGCTCCCCAAC
TTCAAAACCATTTTGGTACCTGACAACAAGAGCATTTTAGAGTAATTAATTTAATAAAGTAAATTAGTATTGCT
GCAAATAGCTAAATTATATTTATTTGAATTGATGGTCAAGAGATTTTCCATTTTTTTTACAGACTGTTCAGTGT
TTGTCAAGCTTCTGGTCTAATATGTACTCGAAAGACTTTCCGCTTACAATTTGTAGAAACACAAATATCGTTTT
CCATACAGCAGTGCCTATATAGTGACTGATTTAACTTTCAATGTCCATCTTTCAAAGGAAGTAACACCAAGGT
ACAATGTTAAAGGAATATTCACTTTACCTAGCAGGGAAAAATACACAAAAACTGCAGATACTTCATATAGCCCA
TTTTAACTTGTATAAACTGTGTGACTTGTGGCGTCTTATAAATAATGCACTGTAAAGATTACTGAATAGTTGTG
TCATGTTAATGTGCCTAATTTCATGTATCTTGTAATCATGATTGAGCCTCAGAATCATTTGGAGAAACTATATT
TTAAAGAACAAGACATACTTCAATGTATTATACAGATAAAGTATTACATGTGTTTGATTTAAAAGGGCGGACA
TTTTATTAAAATCAATATTGTTTTTGCTTTTTCTGAGGAGTCTCTTTCAGTTTCATTTTTTCTCATCCCATGAC
TTCCCTCCGATGGT

FIGURE 74

AGTATGAGGCGCCCACCATGGTGCGATGCGACCGCGGGCTGCAGATGCTGCTGACCACGGCCGGAGCCTTCGCC
GCCTTCTCGCTCATGGCCATCGCCATCGGCACCGACTACTGGCTGTACTCCAGCGCGCACATCTGCAACGGCAC
CAACCTGACCATGGACGACGGGCCCCGCCCCGCCGCGCCCGCGGCGACCTCACCCACTCTGGTCTGTGGCGGG
TGTGCTGCATCGAAGGGATCTATAAAGGGCACTGCTTCCGGATCAATCACTTCCCAGAGGACAATGACTACGAC
CACGACAGCTCGGAGTACCTCCTCCGCATCGTGCGAGCCTCCAGCGTCTTCCCCATCCTCAGCACCATCCTGCT
CCTGCTGGGTGGCCTGTGCATCGGTGCTGGCAGGATCTACAGCCGCAAGAACAACATCGTCCTCAGTGCCGGCA
TCCTCTTCGTGGCTGCAGGCCTCAGTAACATCATCGGTATCATCGTCTACATTTCCAGCAACACAGGTGACCCG
AGTGACAAGCGGGACGAAGACAAAAAGAACCATTACAACTACGGCTGGTCTTTTTACTTTGGAGCTCTGTCTTT
CATTGTGGCTGAGACCGTGGGCGTCCTGGCTGTAAACATTTACATTGAGAAAAATAAAGAGTTGAGGTTTAAGA
CCAAACGGGAATTCCTTAAGGCGTCTTCCTCTTCTCCTTATGCCAGGATGCCGAGCTACAGGTACCGGCGACGG
CGCTCGAGGTCCAGCTCAAGGTCCACCGAGGCCTCGCCCTCCAGGGACGTGTCGCCCATGGGCCTGAAGATCAC
AGGGGCCATCCCCATGGGGGAGCTGTCCATGTACACGCTGTCCAGGGAGCCCCTCAAGGTGACCACCGCAGCCA
GCTACAGCCCCGACCAGGAGGCCAGCTTCCTGCAGGTGCATGACTTTTTCCAGCAGGACCTGAAGGAAGGTTTC
CACGTCAGCATGCTGAACCGACGGACGACCCCTGTGTGA

FIGURE 75

CGGGTCTGATAGTCCCTACCTGTCAGGACTGGTGTTAGGATGAGATAATGTTTGTGAACTGTAAACATATATAA
ACGTGTGCTACTGTGAGAACTGGAACAAAGAAGAGAGGGAGTGAGAGAAATCAAGGGAGGGCTGGGCTGGGAA
AGAACGAAAAGGGAGTCGCGTATAGAGGAGAGGCGACAGTCGCGAGCCACACTTTGCAATGAAACTCTTTAGAC
TTTCTGCCGGGAGAGCGGCCCAGACGCGCCAGGTCTGTAGCAGGAGGCCGCGAGGGCGGGTCCCCAGAAGCCTA
CAGGTGAGTATCGGTTCTCCCCTTCCCGGCTTTCGGTCCGGAGGAGGCGGGAGCAGCTTCCCTGTTCTGATCCT
ATCGCGGGCGGCGCAGGGCCGGCTTGGCCTTCCGTGGGACGGGGAGGGGGCGGGATGTGTCACCCAAATACCA
GTGGGGACGGTCGGTGGTGGAACCAGCCGGGCAGGTCGGGTAGAGTATAAGAGCCGGAGGGAGCGGCCGGGGCG
CAGACGCCTGCAGACCATCCCAGACGCCGGAGCCCGAGCCCCGACGAGTCCCCGCGCCTCATCCGCCCGCGTCC
GGTCCGCGTTCCTCCGCCCCACCATGGCTCGGGGCCCCGGCCTCGCGCCGCCACCGCTGCGGCTGCCGCTGCTG
CTGCTGGTGCTGGCGGCGGTGACCGGCCACACGGCCGCGCAGGACAACTGCACGTGTCCCACCAACAAGATGAC
CGTGTGCAGCCCCGACGGCCCCGGCGGCCGCTGCCAGTGCCGCGCGCTGGGCTCGGGCATGGCGGTCGACTGCT
CCACGCTGACCTCCAAGTGTCTGCTGCTCAAGGCGCGCATGAGCGCCCCCAAGAACGCCCGCACGCTGGTGCGG
CCGAGTGAGCACGCGCTCGTGGACAACGATGGCCTCTACGACCCCGACTGCGACCCCGAGGGCCGCTTCAAGGC
GCGCCAGTGCAACCAGACGTCGGTGTGCTGGTGCGTGAACTCGGTGGGCGTGCGCCGCACGGACAAGGGCGACC
TGAGCCTACGCTGCGATGAGCTGGTGCGCACCCACCACATCCTCATTGACCTGCGCCACCGCCCCACCGCCGGC
GCCTTCAACCACTCAGACCTGGACGCCGAGCTGAGGCGGCTCTTCCGCGAGCGCTATCGGCTGCACCCCAAGTT
CGTGGCGGCCGTGCACTACGAGCAGCCCACCATCCAGATCGAGCTGCGGCAGAACACGTCTCAGAAGGCCGCCG
GTGAAGTGGATATCGGCGATGCCGCCTACTACTTCGAGAGGGACATCAAGGGCGAGTCTCTATTCCAGGGCCGC
GGCGGCCTGGACTTGCGCGTGCGCGGAGAACCCCTGCAGGTGGAGCGCACGCTCATCTATTACCTGGACGAGAT
TCCCCCGAAGTTCTCCATGAAGCGCCTCACCGCCGGCCTCATCGCCGTCATCGTGGTGGTCGTGGTGGCCCTCG
TCGCCGGCATGGCCGTCCTGGTGATCACCAACCGGAGAAAGTCGGGGAAGTACAAGAAGGTGGAGATCAAGGAA
CTGGGGGAGTTGAGAAAGGAACCGAGCTTGTAGGTACCCGGCGGGGCAGGGGATGGGGTGGGGTACCGGATTTC
GGTATCGTCCCAGACCCAAGTGAGTCACGCTTCCTGATTCCTCGGCGCAAAGGAGACGTTTATCCTTTCAAATT
CCTGCCTTCCCCCTCCCTTTTGCGCACACACCAGGTTTAATAGATCCTGGCCTCAGGGTCTCCTTTCTTTCTCA
CTTCTGTCTTGAGGGAAGCATTTCTAAAATGTATCCCCTTTCGGTCCAACAACAGGAAACCTGACTGGGGCAGT
GAAGGAAGGGATGGCACAGCGTTATGTGTAAAAAACAAGTATCTGTATGACAACCCGGGATCGTTTGCAAGTAA
CTGAATCCATTGCGACATTGTGAAGGCTTAAATGAGTTTAGATGGGAAATAGCGTTGTTATCGCCTTGGGTTTA
AATTATTTGATGAGTTCCACTTGTATCATGGCCTACCCGAGGAGAAGAGGAGTTTGTTAACTGGGCCTATGTAG
TAGCCTCATTTACCATCGTTTGTATTACTGACCACATATGCTTGTCACTGGGAAAGAAGCCTGTTTCAGCTGCC
TGAACGCAGTTTGGATGTCTTTGAGGACAGACATTGCCCGGAAACTCAGTCTATTTATTCTTCAGCTTGCCCTT
ACTGCCACTGATATTGGTAATGTTCTTTTTTGTAAAATGTTTGTACATATGTTGTCTTTGATAATGTTGCTGTA
ATTTTTAAAATAAAACACGAATTTAATAAAATATGGGAAAGGCACAAACCAGAAGTCGGCATTTGTGAAAAGT
CCCTCCAGATTTCTATCACTTTGGTCTCTAATTTCCCAAGACTTGTATTTTTTTTTATTTCAAATTATAACAC
TTTTTTTTCCCCCAGAAGTGGGTGTTTCATGTTGCTACTCTGGTGTGTCCCAAGATATCCTAACTGGCCAGTGT
AAATGCTATTCTTTCTAAATAAGATTATTTGGAAACTTCCTCAAACTGCAGGAGGGCGAGCTCTGAGGGCACG
AGAAGCTAAAACTAGCTGCTTTTGATGAAAAGAGTGCCAGTCTTTGGTCATCTCTAAACAAGGCTTATCACCA
ATGGAGACAGAAAACTCTAGTTCAAGAGCTGTACCTCCTTTGAATCCCAGCCCTACTCGAAATAAGTGGTACTA
TTTCCATTTAGCCTTTGAGCAAATCACTTAACTCAAAGGCGTTGTGGCTCTAAGATTAAACGACTTT

FIGURE 76

GCGGCCGCGGAGCAAGAAGGGCGCCGCGTCGTGCGGCCCGCGCAGCCCCGGAGCCATGGGCAAGTGCAGCGGG
CGCTGCACGCTGGTCGCCTTCTGCTGCCTGCAGCTGGTGGCTGCGCTGGAGCGGCAGATCTTTGACTTCCTGGG
CTACCAGTGGGCTCCCATCCTAGCCAACTTCCTGCACATCATGGCAGTCATCCTGGGCATCTTTGGCACCGTGC
AGTACCGCTCCCGGTACCTCATCCTGTATGCAGCCTGGCTGGTGCTCTGGGTTGGCTGGAATGCATTTATCATC
TGCTTCTACTTGGAGGTTGGACAGCTGTCCCAGGACCGGGACTTCATCATGACCTTCAACACATCCCTGCACCG
CTCCTGGTGGATGGAGAATGGGCCAGGCTGCCTGGTGACACCTGTTCTGAACTCCCGCCTGGCTCTGGAGGACC
ACCATGTCATCTCTGTCACTGGCTGCCTGCTTGACTACCCCTACATTGAAGCCCTCAGCAGCGCCCTGCAGATC
TTCCTGGCACTGTTCGGCTTCGTGTTCGCCTGCTACGTGAGCAAAGTGTTCCTGGAGGAGGAGGACAGCTTTGA
CTTCATCGGCGGCTTTGACTCCTACGGATACCAGGCGCCCCAGAAGACGTCGCATTTACAGCTGCAGCCTCTGT
ACACGTCGGGGTAGCCTCTGCCCCGCGCCCACCCCGGCGCCTCGCCCTGGGCTGACCGCAGCTGCCGCGAGCTC
GGGCCAAGGCGCAGGCGTGTCCCCTGGTGGCCCGCGCTCTCACTGCAGCCTGTGCCCAACCCCGCGTCTGCAT
CTGGAGATGCGGACTTGGACGTGGACTTGGACTTGGACTTGGATTTGAGCTTGGCTCTTCGCAGCCCGGACTTC
GGAGGAGTGGGGCGGGGCGGGGAGGGGCACCACGGGTTTTTGTTTTTTGTTTGTTTGTTTTTAATCTCAGCC
TTGGCGTGAGCTGGGGCCTTCCTCTCTTCTCCAGCCTCTCCCTTTCACTCTTCGCCCAGCATCCTGCCCCCTG
TCCAAAAACAGCAGGACATCAGGCCCATCCCATCCCACCACACTCACTCACCAGCTCTGGGGAAAGCTACTGTG
AACTAGGAGCAGGATTCCTGGGTTCTAATCGCAGGTCCATCACTGACTGTGACGTCTAGCAAAGCCCTTGCCCT
CTCTGAGCCTCGGTTTCCGCACCTCAAGTAATTAATCCCTTAGCAAATGGACTCTTTTAGACTTCTCATTTAAC
TCAATTCCCTGAGCTAGACTGGGATTAAAATTCTCATTTTGCAGTACATTAAAACTGATGCCCAGAGATGTGAT
TTGCTTGAGGCCACACAGCTAGATTTTTGGTGGAAGTGGGCCTTGAACACAGTGTACTTTCTGCAGTTTCTGAC
TGTAAAACCCAGTGTCTGCTCTCTGAGTTCCATTTCCAAGCCCCCCTCCATCTTGGACCTATGTGGTCTCCACC
ATATTCACACACCACCACCACCACTTGCCAATGCCTCTCTTAAAGCAATATACCCATTCGTTCTCTTATTGGGA
ACTGGATGGATGAAGCCCCAAATTCAGCCCCACCCACAGAGAAGCCTTCCTACACTCAGCCTCTGTCCACCCTT
GGCAAATCTTTCAAGCTCTCTCCTCCAGGAAAGTGGGGCCCCAACTCAGTCACTCCACCCCCTTCCAGGTCCCT
GAGGCTGGTTCTACTGTATCCCCATCACCTCCACAACTCCACTCACCCCTGACGGCTCCATCCACCTCACCAGT
TGGAAGGCTTGTGGTTTCAGAGAGGAGCAATGCTGGTCAGCGCTGCCCAGACTCCAGTGTTTACAGATCACCAG
CATTTACAACCAATCCAATGGCCAGAAGCCTCCTCTAACAAGCCCAGAAGGAGTTCTGAAGGGGCAGATGGGGG
TGTGAGTAGTCGGGGAGTCGGGATTGCCAGCACCCTCACCCTTCCTTGGGGGCAAGTAGAGGTGAGAACACTTT
CCCCACCTCCCTCCACAGACACTCCTGAGGACGCTGCATCCCACGCACTGCCTGGTGCGTCCATAGAGAGAGGA
TCAGGTCTCAGCATTTCATCTGTGAAAGAGGCATGGCCCTGGGTTAGAAAGGAGGGCAGGAGACATGGAGGAAC
TGGGGGGCACCCAGATGGTGCAGATGGTTTGCACACCTGAGCCTGTCTGTGGTGACCATTCCGCTCCTCTCCCA
CTACCCTCCAATCTATCATTCCCTACTCTCTAAGGCCAAAATATCCTGAGCAAGGCTGGCAACCCCACCCCACC
ATCCCAAATGCAAGCAGCCAGGCCCAGGAGTTCCTCTGGCCCCACAGGCATGGAGCTCCCAGCTGGTGGGTAC
AGCTTGAGAGGGGGCAGCTCCCTCAGGCTAAGCTACTGCCCTTCACTGGGCCAGCCCTGCCTCCAGCCCTCAC
CTCTCTCACCCCAACTCTCCCCCAAGCCCCTTTCTACTCAACGGGTGTAGCCACTGGTGCTTTGAAGCCTTTTG
TTTTTATAAGATGGTTTTTGCAAGGGGACCAGGTTCTCTTTTCACTGGGACCTTGCAAGGAGGGGAGTGCTCTC
CTGGTTTCTGTGCAGGCGGGTTGATTAAAGATGGTGTTTTCTTCTCT

FIGURE 77

GGCGGGGAGAGGAGAGGAGAGAAGAGCCGCGGGGGGCCCAGCCCGGAGCCAGGATGCCCGCGCCGCGCGCCCGG
GAGCAGCCCCGCGTGCCCGGGGAGCGCCAGCCGCTGCTGCCTCGCGGTGCGCGGGGCCCTCGACGGTGGCGGCG
GGCGGCGGGCGCGGCCGTGCTGCTGGTGGAGATGCTGGAGCGCGCCGCCTTCTTCGGCGTCACCGCCAACCTCG
TGCTGTACCTCAACAGCACCAACTTCAACTGGACCGGCGAGCAGGCGACGCGCGCCGCGCTGGTATTCCTGGGC
GCCTCCTACCTGCTGGCGCCCGTGGGCGGCTGGCTGGCCGACGTGTACCTGGGCCGCTACCGCGCGGTCGCGCT
CAGCCTGCTGCTCTACCTGGCCGCCTCGGGCCTGCTGCCCGCCACCGCCTTCCCCGACGGCCGCAGCTCCTTCT
GCGGAGAGATGCCCGCGTCGCCGCTGGGACCTGCCTGCCCCTCGGCCGGCTGCCCGCGCTCCTCGCCCAGCCCC
TACTGCGCGCCCGTCCTCTACGCGGGCCTGCTGCTACTCGGCCTGGCCGCCAGCTCCGTCCGGAGCAACCTCAC
CTCCTTCGGTGCCGACCAGGTGATGGATCTCGGCCGCGACGCCACCCGCCGCTTCTTCAACTGGTTTTACTGGA
GCATCAACCTGGGTGCTGTGCTGTCGCTGCTGGTGGTGGCGTTTATTCAGCAGAACATCAGCTTCCTGCTGGGC
TACAGCATCCCTGTGGGCTGTGTGGGCCTGGCATTTTTCATCTTCCTCTTTGCCACCCCCGTCTTCATCACCAA
GCCCCCGATGGGCAGCCAAGTGTCCTCTATGCTTAAGCTCGCTCTCCAAAACTGCTGCCCCAGCTGTGGCAAC
GACACTCGGCCAGAGACCGTCAATGTGCCCGCGTGCTGGCCGACGAGAGGTCTCCCCAGCCAGGGGCTTCCCCG
CAAGAGGACATCGCCAACTTCCAGGTGCTGGTGAAGATCTTGCCCGTCATGGTGACCCTGGTGCCCTACTGGAT
GGTCTACTTCCAGATGCAGTCCACCTATGTCCTGCAGGGTCTTCACCTCCACATCCCAAACATTTTCCCAGCCA
ACCCGGCCAACATCTCTGTGGCCCTGAGAGCCCAGGGCAGCAGCTACACGATCCCGGAAGCCTGGCTCCTCCTG
GCCAATGTTGTGGTGGTGCTGATTCTGGTCCCTCTGAAGGACCGCTTGATCGACCCTTTACTGCTGCGGTGCAA
GCTGCTTCCCTCTGCTCTGCAGAAGATGGCGCTGGGGATGTTCTTTGGTTTTACCTCCGTCATTGTGGCAGGAG
TCCTGGAGATGGAGCGCTTACACTACATCCACCACAACGAGACCGTGTCCCAGCAGATTGGGGAGGTCCTGTAC
AACGCGGCACCACTGTCCATCTGGTGGCAGATCCCTCAGTACCTGCTCATTGGGATCAGTGAGATCTTTGCCAG
CATCCCAGGCCTGGAGTTTGCCTACTCAGAGGCCCCGCGCTCCATGCAGGGCGCCATCATGGGCATCTTCTTCT
GCCTGTCGGGGGTGGGCTCACTGTTGGGCTCCAGCCTAGTGGCACTGCTGTCCTTGCCCGGGGGCTGGCTGCAC
TGCCCCAAGGACTTTGGGAACATCAACAATTGCCGGATGGACCTCTACTTCTTCCTGCTGGCTGGCATTCAGGC
CGTCACGGCTCTCCTATTTGTCTGGATCGCTGGACGCTATGAGAGGGCGTCCCAGGGCCCAGCCTCCCACAGCC
GTTTCAGCAGGGACAGGGGCTGAACAGGCCCTATTCCAGCCCCCTTGCTTCAC

FIGURE 78A

```
GGCCGCGGGCTCTCGCGGGGCGGCGACGCCGCGGGGAGGATGCTGCTTGCCGCGCCCGCGTCCTCACCGTCCTC
CCGGGCCGCCTGCTGGGGCTTTGTTGTGGCCCGGACGCCGCGGGCCACCCCCTGAAGTCGCCTGCCGCCGCCGC
CGCCGCACCTAGCGGACGGGCGGGCGGGCGCGCGTGTGCCCAGGAGTGCGCGCCTGTCGCGGTGGTGGGTGCAG
GACTGGACCCACGGGCCCATTGTGCGCCCGCCCGCGGCAGCCAGGACCATGTGGGTGAACCCGGAGGAGGTGTT
GCTGGCCAACGCGCTGTGGATCACCGAGAGGGCCAACCCATACTTCATCCTGCAGCGGAGGAAGGGCCACGCCG
GCGATGGAGGCGGCGGCGGCGGACTGGCGGGCCTGCTGGTGGGTACCCTTGATGTTGTGTTGGACTCCAGCGCC
CGGGTCGCTCCTTACCGAATCTTGTACCAGACTCCAGACTCCCTGGTCTACTGGACCATCGCCTGTGGTGGTTC
CAGGAAAGAAATCACTGAACACTGGGAATGGCTTGAGCAAAATCTCTTGCAGACACTCTCCATCTTTGAAAATG
AGAATGATATCACCACATTTGTGAGAGGAAAAATACAGGGCATCATTGCAGAATACAACAAAATCAATGATGTA
AAGGAAGATGATGACACGGAGAAGTTTAAAGAAGCCATTGTGAAATTTCATAGGCTGTTTGGGATGCCAGAGGA
AGAGAAACTCGTCAACTATTACTCTTGCAGCTATTGGAAGGGGAAGGTCCCCCGTCAGGGTTGGATGTACCTCA
GCATTAACCACCTTTGCTTTTATTCTTTTCTTATGGGAAGGGAAGCGAAACTGGTCATCCGGTGGGTAGACATC
ACTCAGCTTGAGAAGAATGCCACCCTGCTTCTGCCTGATGTGATCAAAGTGAGCACACGGTCCAGTGAGCATTT
CTTCTCTGTATTCCTCAACATCAACGAGACCTTCAAGTTAATGGAGCAGCTTGCCAACATAGCCATGAGGCAAC
TCTTAGACAATGAGGGATTTGAACAAGATCGATCCCTGCCCAAACTCAAAAGGAAATCTCCTAAAAAAGTGTCT
GCTCTAAAACGTGATCTTGATGCCAGGGCAAAGAGTGAGAGATACCGTGCACTTTTCCGGCTGCCCAAAGATGA
AAAATTAGATGGCCACACAGACTGCACTCTCTGGACTCCATTTAACAAAATGCACATTTTGGGGCAGATGTTTG
TGTCCACAAATTACATCTGTTTTACCAGCAAGGAGGAGAACTTATGTAGCCTCATTATCCCGCTCCGTGAGGTG
ACAATTGTGGAAAAGGCAGACAGCTCCAGTGTGCTCCCCAGTCCCTTATCCATCAGCACCCGAAACAGGATGAC
CTTCCTATTTGCCAACTTGAAAGATAGAGACTTTCTAGTGCAGAGGATCTCAGATTTCCTGCAACAGACTACTT
CCAAAATATATTCTGACAAGGAGTTTGCAGGAAGTTACAACAGTTCAGATGATGAGGTGTACTCTCGACCCAGC
AGCCTCGTCTCCTCCAGCCCCCAGAGAAGCACGAGCTCTGATGCTGATGGAGAGCGCCAGTTTAACCTAAATGG
CAACAGCGTCCCCACAGCCACACAGACCCTGATGACCATGTATCGGCGGCGGTCTCCGAGGAGTTCAACCCGA
AATTGGCCAAAGAGTTTCTGAAAGAGCAAGCCTGGAAGATTCACTTTGCTGAGTATGGGCAAGGGATCTGCATG
TACCGCACAGAGAAAACGCGGGAGCTGGTCGTTGAAGGGCATCCCGGAGCATGCGTGGGGAGCTCTGGCTGCT
GCTGTCAGGTGCCATCAATGAGAAGGCCACACATCCTGGGTACTATGAAGACCTAGTGGAGAAGTCCATGGGGA
AGTATAATCTCGCCACGGAGGAGATTGAGAGGGATTTACACCGCTCCCTTCCAGAACACCCAGCTTTTCAGAAT
GAAATGGGCATTGCTGCACTAAGGAGAGTCTTAACAGCTTATGCTTTTCGAAATCCCAACATAGGGTATTGCCA
GGCCATGAATATTGTCACTTCAGTGCTGCTGCTTTATGCCAAAGAGGAGGAAGCTTTCTGGCTGCTTGTGGCTT
TGTGTGAGCGCATGCTCCCAGATTACTACAACACCAGAGTTGTGGGTGCACTGGTGGACCAAGGTGTCTTTGAG
GAGCTAGCACGAGACTACGTCCCACAGCTGTACGACTGCATGCAAGACCTGGGCGTGATTTCCACCATCTCCCT
GTCTTGGTTCCTCACACTATTTCTCAGTGTGATGCCTTTTGAGAGTGCAGTTGTGGTTGTTGACTGTTTCTTCT
ATGAAGGAATTAAAGTGATATTCCAGTTGGCCCTAGCTGTGCTGGATGCAAATGTGGACAAACTGTTGAACTGC
AAGGATGATGGGGAGGCCATGACCGTTTTGGGAAGGTATTTAGACAGTGTGACCAATAAAGACAGCACACTGCC
TCCCATTCCTCACCTCCACTCCTTGCTCAGCGATGATGTGGACCTTACCCTGAGGTAGACATCTTTAGACTCA
TCAGAACTTCCTACGAGAAATTCGGAACTATCCGGGCAGATTTGATTGAACAGATGAGATTCAAACAGAGACTG
AAAGTGATCCAGACGCTGGAGGATACTACGAAACGCAACGTGGTACGAACCATTGTGACAGAAACTTCCTTTAC
CATTGATGAGCTGGAAGAACTTTATGCTCTTTTCAAGGCAGAACATCTCACCAGCTGCTACTGGGCGGGAGCA
GCAACGCGCTGGACCGGCATGACCCCAGCCTGCCCTACCTGGAACAGTATCGCATTGACTTCGAGCAGTTCAAG
GGAATGTTTGCTCTTCTCTTTCCTTGGGCATGTGGAACTCACTCTGACGTTCTGGCCTCCCGCTTGTTCCAGTT
ATTAGATGAAAATGGAGACTCTTTGATTAACTTCCGGGAGTTTGTCTCTGGGCTAAGTGCTGCATGCCATGGGG
ACCTCACAGAGAAGCTCAAACTCCTGTACAAAATGCACGTCTTGCCTGAGCCATCCTCTGATCAAGATGAACCA
GATTCTGCTTTTGAAGCAACTCAGTACTTCTTTGAAGATATTACCCCAGAATGTACACATGTTGTTGGATTGGA
TAGCAGAAGCAAACAGGGTGCAGATGATGGCTTTGTTACGGTGAGCCTAAAGCCAGACAAAGGGAAGAGAGCAA
ATTCCCAAGAAAATCGTAATTATTTGAGACTGTGGACTCCAGAAAATAAATCTAAGTCAAAGAATGCAAAGGAT
TTACCCAAATTAAATCAGGGGCAGTTCATTGAACTGTGTAAGACAATGTATAACATGTTCAGCGAAGACCCCAA
TGAGCAGGAGCTGTACCATGCCACGGCAGCAGTGACCAGCCTCCTGCTGGAGATTGGGGAGGTCGGCAAGTTGT
TCGTGGCCCAGCCTGCAAAGGAGGGCGGGAGCGGAGGCAGTGGGCCGTCCTGCCACCAGGGCATCCCAGGCGTG
CTCTTCCCCAAGAAAGGGCCAGGCCAGCCTTACGTGGTGGAGTCTGTTGAGCCCCTGCCGGCCAGCCTGGCCCC
CGACAGCGAGGAACACTCCCTTGGAGGACAAATGGAGGACATCAAGCTGGAGGACTCCTCGCCCCGGGACAACG
GGGCCTGCTCCTCCATGCTGATCTCTGACGACGACACCAAGGACGACAGCTCCATGTCCTCATACTCGGTGCTG
AGTGCCGGCTCCCACGAGGAGGACAAGCTGCACTGCGAGGACATCGGAGAGGACACGGTCCTGGTGCGGAGCGG
CCAGGGCACGGCGGCACTGCCCCGGAGCACCAGCCTGGACCGGGACTGGGCCATCACCTTCGAGCAGTTCCTGG
CCTCCCTCTTAACTGAGCCTGCCCTGGTCAAGTACTTTGACAAGCCCGTGTGCATGATGGCCAGGATTACCAGT
GCAAAAAACATCCGGATGATGGGCAAGCCCCTCACCTCGGCCAGTGACTATGAAATCTCGGCCATGTCCGGCTG
ACACGGGCGCCTTCCCGGGGAGTGGGAGGAGAGGGAGGGGAGGGATTTTTTATGTTCTTCTGTGTTGAGTTTT
TTCTTTCTTTCTTTTAAATTAAATATTTATTAGTACCTGGCTTGAAGCCTAGTGTTTTCATAATGTAATTCAAT
GAAAACTGTTGGAGAAATATTTAAACACCTCAATGTAGGTACATTACACTCTTGTTGCGGGGAGGGGATTTACC
AGAATACAGTTTATTTCGTGAATTCTAAAAAACAAAAAGATGAATCTGTCAGTGATATGTGTGTATTATAACTT
ATTAATCTTGCTGTTGAGCTGTATACATGGTTTAAAAAATAGTACTGTTTAATGCTAAGTAAGGCAGCAGTCAT
TTGTGTATTCAGGCTTTTTAAATAAAATTAGAGCTGTAAGGAAAATGAAAAGCCACAAATGCAAGACTGTTCTT
```

FIGURE 78B

```
AAATGGAAGGCATAGTCAGCGAGGGTAAATCCTATACCACTTTAGGAAGTATTAAAAATATTTTTAAGATTTGA
AATATATTTCATAGAAGTCCTCTATTCAAAATCATATTCCACAGATGTTCCCCTTCAAAGGGAAAACATTTGGG
GTTCTAAACAGTTATGAAAGTAAGTGATTTTTACATGATTCCAGAATAACACTTGTATTGACCAATTTAGACAG
ATACCAGACCAATTTTGCATTTAAGAAATTGTTCTGATTATTTACGTCAACTCATTAGAATTCAGTGAAAAGTA
ACAGTCTTTTGTCACAGAGAATCTGAAAGTAGCAGCAAAGACAGAGGGCTCATGACAGGTTTTTGCTTTTGCTT
TGCTTTTGTTTTTGAAAGAGTAAAAGTACTGATGCTTCTGATACTGGATGTTTAGCTTCTTACTGCAAAAACAT
AAGTAAAACAGTCAACTTTACCATTTCCGTATTCTCCATAGATTGAAGAAATTTATACCACATATCGCATATGA
CCATCTTTCCATCAAATCAATGTAGAGATAATGTAAACTGAAAAAAAATCTGCAAGATAATGTAACTGAATGTT
TTAAAAACAGAACTTGTCACTTTATATAAAAGAATAGTATGCTCTATTTCCTGAATGGATGTGGAAATGAAAGC
TAGCGCACCTGCACTTTGAATTCTTGCTTCTTTTTTATTACTGTTATGATTTGCTTTTTACAGATGTTGGACG
ATTTTTTCTTCTGATTGTTGAATTCATAATCATGGTCTCATTTCCTTTGCTTCTTTGGAATATTTCTTTCAACA
CATTCCTTTATTTTATTATACATTGTGTCCTTTTTTAGCTATTGCTGCTGTTGTTTTTATTCTATTTACAGG
ATGATTTTTAAACTGTCAAATGAAGTAGTGTTAACCTCAAATAGGCTAAATGTGAACAAATAAAATACAGCAAA
TACTCAGATACAGCTTTTTATCTTTGTGCTTGAGTTCCTGCCTAAGGAATAACATTATTCTTTTGACAACTTTT
GCAGGGGAAATTATATCAGGCAACCATTTTGATTAAGTAAATAAATTTTATAGGCAAACATATAGAGAGANATA
CAATTTGTAGTATATCAATGACTATATTTAAAATAAGGANTATAATTGTTATCAGTTATCTAACTTAAAATGCT
TATCCATAATGATCAGTGATATTCAGCTTTTTAAAATATGCTTGTTGG
```

FIGURE 79

MRAAYLFLLFLPAGLLAQGQYDLDPLPPFPDHVQYTHYSDQIDNPDYYDYQEVTPRPSEEQFQFQSQQQVQQEV
IPAPTPEPGNAELEPTEPGPLDCREEQYPCTRLYSIHRPCKQCLNEVCFYSLRRVYVINKEICVRTVCAHEELL
RADLCRDKFSKCGVMASSGLCQSVAASCARSCGSC

Signal sequence.

amino acids 1-19

N-myristoylation sites.

amino acids 161-166, 167-172

FIGURE 80

```
MAARPLPVSPARALLLALAGALLAPCEARGVSLWNEGRADEVVSASVRSGDLWIPVKSFDSKNHPEVLNIRLQR
ESKELIINLERNEGLIASSFTETHYLQDGTDVSLARNYTVILGHCYYHGHVRGYSDSAVSLSTCSGLRGLIVFE
NESYVLEPMKSATNRYKLFPAKKLKSVRGSCGSHHNTPNLAAKNVFPPPSQTWARRHKRETLKATKYVELVIVA
DNREFQRQGKDLEKVKQRLIEIANHVDKFYRPLNIRIVLVGVEVWNDMDKCSVSQDPFTSLHEFLDWRKMKLLP
RKSHDNAQLVSGVYFQGTTIGMAPIMSMCTADQSGGIVMDHSDNPLGAAVTLAHELGHNFGMNHDTLDRGCSCQ
MAVEKGGCIMNASTGYPFPMVFSSCSRKDLETSLEKGMGVCLFNLPEVRESFGGQKCGNRFVEEGEECDCGEPE
ECMNRCCNATTCTLKPDAVCAHGLCCEDCQLKPAGTACRDSSNSCDLPEFCTGASPHCPANVYLHDGHSCQDVD
GYCYNGICQTHEQQCVTLWGPGAKPAPGICFERVNSAGDPYGNCGKVSKSSFAKCEMRDAKCGKIQCQGGASRP
VIGTNAVSIETNIPLQQGGRILCRGTHVYLGDDMPDPGLVLAGTKCADGKICLNRQCQNISVFGVHECAMQCHG
RGVCNNRKNCHCEAHWAPPFCDKFGFGGSTDSGPIRQADNQGLTIGILVTILCLLAAGFVVYLKRKTLIRLLFT
NKKTTIEKLRCVRPSRPPRGFQPCQAHLGHLGKGLMRKPPDSYPPKDNPRRLLQCQNVDISRPLNGLNVPQPQS
TQRVLPPLHRAPRAPSVPARPLPAKPALRQAQGTCKPNPPQKPLPADPLARTTRLTHALARTPGQWETGLRLAP
LRPAPQYPHQVPRSTHTAYIK
```

Signal sequence.
amino acids 1-28

Transmembrane domain.
amino acids 709-729

N-glycosylation sites.
amino acids 111-114, 149-152, 381-384, 452-455, 651-654 cAMP- and cGMP-dependent protein kinase phosphorylation site.
amino acids 206-209, 730-733, 742-745

N-myristoylation sites.
amino acids 88-93, 103-108, 177-182, 180-185, 313-318, 343-348, 377-382, 407-412, 423-428, 424-429, 524-529, 630-635, 635-640, 656-661, 668-673, 694-699, 708-713, 712-717, 878-883

Neutral zinc metallopeptidases, zinc-binding region signature.
amino acids 347-356

Disintegrins proteins.
amino acids 454-504, 410-460, 486-536

FIGURE 81

MASRSMRLLLLLSCLAKTGVLGDIIMRPSCAPGWFYHKSNCYGYFRKLRNWSDAELECQSYGNGAHLASILSLK
EASTIAEYISGYQRSQPIWIGLHDPQKRQQWQWIDGAMYLYRSWSGKSMGGNKHCAEISSNNNFLTWSSNECNK
RQHFLCKYRP

Signal sequence.

amino acids 1-22

N-glycosylation site.

amino acids 50-53

N-myristoylation sites.

amino acids 64-69, 125-130

C-type lectin domain signature.

amino acids 129-154

Lectin C-type domain.

amino acids 47-156

FIGURE 82

MATMENKVICALVLVSMLALGTLAEAQTETCTVAPRERQNCGFPGVTPSQCANKGCCFDDTVRGVPWCFYPNTI
DVPPEEECEF

Signal sequence.
amino acids 1-24

N-myristoylation sites.
amino acids 45-50, 64-69

Trefoil (P-type) domain.
amino acids 30-71

FIGURE 83

MLPQIPFLLLVSLNLVHGVFYAERYQTPTGIKGPLPNTKTQFFIPYTIKSKGIAVRGEQGTPGPPGPAGPRGHP
GPSGPPGKPGYGSPGLQGEPGLPGPPGPSAVGKPGVPGLPGKPGERGPYGPKGDVGPAGLPGPRGPPGPPGIPG
PAGISVPGKPGQQGPTGAPGPRGFPGEKGAPGVPGMNGQKGEMGYGAPGRPGERGLPGPQGPTGPSGPPGVGKR
GENGVPGQPGIKGDRGFPGEMGPIGPPGPQGPPGERGPEGIGKPGAAGAPGQPGIPGTKGLPGAPGIAGPPGPP
GFGKPGLPGLKGERGPAGLPGGPGAKGEQGPAGLPGKPGLTGPPGNMGPQGPKGIPGSHGLPGPKGETGPAGPA
GYPGAKGERGSPGSDGKPGYPGKPGLDGPKGNPGLPGPKGDPGVGGPPGLPGPVGPAGAKGMPGHNGEAGPRGA
PGIPGTRGPIGPPGIPGFPGSKGDPGSPGPPGPAGIATKGLNGPTGPPGPPGPRGPSGEPGLPGPPGPPGPPGQ
AVMPEGFIKAGQRPSLSGTPLVSANQGVTGMPVSAFTVILSKAYPAIGTPIPFDKILYNRQQHYDPRTGIFTCQ
IPGIYYFSYHVHVKGTHVWVGLYKNGTPVMYTYDEYTKGYLDQASGSAIIDLTENDQVWLQLPNAESNGLYSSE
YVHSSFSGFLVAPM

Signal sequence.
amino acids 1-18

Tyrosine kinase phosphorylation site.
amino acids 116-123

N-myristoylation sites.
amino acids 18-23, 276-281, 317-322, 350-355, 380-385, 415-420, 446-451, 529-534, 548-553, 587-592, 613-618, 661-666

Amidation site.
amino acids 219-222

C1q domain signature.
amino acids 571-601

C1q domain.
amino acids 553-677

Collagen triple helix repeat (20 copies).
amino acids 92-150, 156-214, 223-281, 282-340, 344-403, 404-463, 464-522

FIGURE 84

MPLPPLLLLLLAAPWGRAVPCVSGGLPKPANITFLSINMKNVLQWTPPEGLQGVKVTYTVQYFIYGQKKWLNKS
ECRNINRTYCDLSAETSDYEHQYYAKVKAIWGTKCSKWAESGRFYPFLETQIGPPEVALTTDEKSISVVLTAPE
KWKRNPEDLPVSMQQIYSNLKYNVSVLNTKSNRTWSQCVTNHTLVLTWLEPNTLYCVHVESFVPGPPRRAQPSE
KQCARTLKDQSSEFKAKIIFWYVLPISITVFLFSVMGYSIYRYIHVGKEKHPANLILIYGNEFDKRFFVPAEKI
VINFITLNISDDSKISHQDMSLLGKSSDVSSLNDPQPSGNLRPPQEEEEVKHLGYASHLMEIFCDSEENTEGTS
LTQQESLSRTIPPDKTVIEYEYDVRTTDICAGPEEQELSLQEEVSTQGTLLESQAALAVLGPQTLQYSYTPQLQ
DLDPLAQEHTDSEEGPEEEPSTTLVDWDPQTGRLCIPSLSSFDQDSEGCEPSEGDGLGEEGLLSRLYEEPAPDR
PPGENETYLMQFMEEWGLYVQMEN

Signal sequence.
amino acids 1-18

Transmembrane domain.
amino acids 239-259

N-glycosylation sites.
amino acids 31-34, 72-75, 80-83, 171-174, 180-183, 189-192, 304-307, 523-526

Tyrosine kinase phosphorylation sites.
amino acids 385-392, 518-526

N-myristoylation sites.
amino acids 53-58, 106-111, 368-373, 492-497

Phosphatidylinositol 3- and 4-kinases proteins.
amino acids 253-279

Tissue factor.
amino acids 1-278

FIGURE 85

MRAPGRPALRPLPLPPLLLLLLLAAPWGRAVPCVSGGLPKPANITFLSINMKNVLQWTPPEGLQGVKVTYTVQYF
IYGQKKWLNKSECRNINRTYCDLSAETSDYEHQYYAKVKAIWGTKCSKWAESGRFYPFLETQIGPPEVALTTDE
KSISVVLTAPEKWKRNPEDLPVSMQQIYSNLKYNVSVLNTKSNRTWSQCVTNHTLVLTWLEPNTLYCVHVESFV
PGPPRRAQPSEKQCARTLKDQSSEFKAKIIFWYVLPISITVFLFSVMGYSIYRYIHVGKEKHPANLILIYGNEF
DKRFFVPAEKIVINFITLNISDDSKISHQDMSLLGKSSDVSSLNDPQPSGNLRPPQEEEEVKHLGYASHLMEIF
CDSEENTEGTSLTQQESLSRTIPPDKTVIEYEYDVRTTDICAGPEEQELSLQEEVSTQGTLLESQAALAVLGPQ
TLQYSYTPQLQDLDPLAQEHTDSEEGPEEEPSTTLVDWDPQTGRLCIPSLSSFDQDSEGCEPSEGDGLGEEGLL
SRLYEEPAPDRPPGENETYLMQFMEEWGLYVQMEN

Signal sequence.
amino acids 1-29

Transmembrane domain.
amino acids 240-270

FIGURE 86

MAAARLCLSLLLLSTCVALLLQPLLGAQGAPLEPVYPGDNATPEQMAQYAADLRRYINMLTRPRYGKRHKEDTL
AFSEWGSPHAAVPRELSPLDL

Signal sequence.

amino acids 1-29

N-myristoylation site.

amino acids 80-85

Amidation site.

amino acids 65-68

Pancreatic hormone family signature.

amino acids 49-65

Pancreatic hormone peptide.

amino acids 30-65

FIGURE 87

MGPPSAPPCRLHVPWKEVLLTASLLTFWNPPTTAKLTIESTPFNVAEGKEVLLLAHNLPQNRIGYSWYKGERVD
GNSLIVGYVIGTQQATPGPAYSGRETIYPNASLLIQNVTQNDTGFYTLQVIKSDLVNEEATGQFHVYPELPKPS
ISSNNSNPVEDKDAVAFTCEPEVQNTTYLWWVNGQSLPVSPRLQLSNGNMTLTLLSVKRNDAGSYECEIQNPAS
ANRSDPVTLNVLYGPDGPTISPSKANYRPGENLNLSCHAASNPPAQYSWFINGTFQQSTQELFIPNITVNNSGS
YMCQAHNSATGLNRTTVTMITVSGSAPVLSAVATVGITIGVLARVALI

Signal sequence.
amino acids 1-34

Transmembrane domain.
amino acids 322-342

N-glycosylation sites.
amino acids 104-107, 111-114, 115-119, 152-155, 173-176, 197-200, 224-227, 256-259, 274-277, 288-291, 292-295, 309-312

Tyrosine kinase phosphorylation site.
amino acids 206-213

N-myristoylation sites.
amino acids 85-90, 211-216, 295-300, 307-312, 332-337

Immunoglobulin domain.
amino acids 160-217, 252-301

FIGURE 88

MELRVLLCWASLAAALEETLLNTKLETADLKWVTFPQVDGQWEELSGLDEEQHSVRTYEVCDVQRAPGQAHWLR
TGWVPRRGAVHVYATLRFTMLECLSLPRAGRSCKETFTVFYYESDADTATALTPAWMENPYIKVDTVAAEHLTR
KRPGAEATGKVNVKTLRLGPLSKAGFYLAFQDQGACMALLSLHLFYKKCAQLTVNLTRFPETVPRELVVPVAGS
CVVDAVPAPGPSPSLYCREDGQWAEQPVTGCSCAPGFEAAEGNTKCRACAQGTFKPLSGEGSCQPCPANSHSNT
IGSAVCQCRVGYFRARTDPRGAPCTTPPSAPRSVVSRLNGSSLHLEWSAPLESGGREDLTYALRCRECRPGGSC
APCGGDLTFDPGPRDLVEPWVVVRGLRPDFTYTFEVTALNGVSSLATGPVPFEPVNVTTDREVPPAVSDIRVTR
SSPSSLSLAWAVPRAPSGAVLDYEVKYHEKGAEGPSSVRFLKTSENRAELRGLKRGASYLVQVRARSEAGYGPF
GQEHHSQTQLDESEGWREQLALIAGTAVVGVVLVLVVIVVAVLCLRKQSNGREAEYSDKHGQYLIGHGTKVYID
PFTYEDPNEAVREFAKEIDVSYVKIEEVIGAGEFGEVCRGRLKAPGKKESCVAIKTLKGGYTERQRREFLSEAS
IMGQFEHPNIIRLEGVVTNSMPVMILTEFMENGALDSFLRLNDGQFTVIQLVGMLRGIASGMRYLAEMSYVHRD
LAARNILVNSNLVCKVSDFGLSRFLEENSSDPTYTSSLGGKIPIRWTAPEAIAFRKFTSASDAWSYGIVMWEVM
SFGERPYWDMSNQDVINAIEQDYRLPPPPDCPTSLHQLMLDCWQKDRNARPRFPQVVSALDKMIRNPASLKIVA
RENGGASHPLLDQRQPHYSAFGSVGEWLRAIKMGRYEESFAAAGFGSFELVSQISAEDLLRIGVTLAGHQKKIL
ASVQHMKSQAKPGTPGGTGGPAPQY

Signal sequence.
amino acids 1-15
Transmembrane domain.
amino acids 539-559
N-glycosylation sites.
amino acids 203-206, 335-338, 426-429, 768-771
Glycosaminoglycan attachment site.
amino acids 280-283
cAMP- and cGMP-dependent protein kinase phosphorylation sites.
amino acids 564-567, 639-642, 795-798
Tyrosine kinase phosphorylation sites.
amino acids 508-515, 588-596, 608-614, 729-736
N-myristoylation sites.
amino acids 152-157, 182-187, 264-269, 298-303, 317-322, 374-379, 496-501,
681-686, 699-704, 719-724, 723-728, 951-956, 975-980
Amidation site.
amino acids 637-640
Tyrosine protein kinases specific active-site signature.
amino acids 736-748

FIGURE 89

```
MAQLFLPLLAALVLAQAPAALADVLEGDSSEDRAFRVRIAGDAPLQGVLGGALTIPCHVHYLRPPPSRRAVLGS
PRVKWTFLSRGREAEVLVARGVRVKVNEAYRFRVALPAYPASLTDVSLALSELRPNDSGIYRCEVQHGIDDSSD
AVEVKVKGVVFLYREGSARYAFSFSGAQEACARIGAHIATPEQLYAAYLGGYEQCDAGWLSDQTVRYPIQTPRE
ACYGDMDGFPGVRNYGVVDPDDLYDVYCYAEDLNGELFLGDPPEKLTLEEARAYCQERGAEIATTGQLYAAWDG
GLDHCSPGWLADGSVRYPIVTPSQRCGGGLPGVKTLFLFPNQTGFPNKHSRFNVYCFRDSAQPSAIPEASNPAS
NPASDGLEAIVTVTETLEELQLPQEATESESRGAIYSIPIMEDGGGGSSTPEDPAEAPRTLLEFETQSMVPPTG
FSEEEGKALEEEEKYEDEEEKEEEEEEEVEDEALWAWPSELSSPGPEASLPTEPAAQEKSLSQAPARAVLQPG
ASPLPDGESEASRPPRVHGPPTETLPTPRERNLASPSPSTLVEAREVGEATGGPELSGVPRGESEETGSSEGAP
SLLPATRAPEGTRELEAPSEDNSGRTAPAGTSVQAQPVLPTDSASRGGVAVVPASGDCVPSPCHNGGTCLEEEE
GVRCLCLPGYGGDLCDVGLRFCNPGWDAFQGACYKHFSTRRSWEEAETQCRMYGAHLASISTPEEQDFINNRYR
EYQWIGLNDRTIEGDFLWSDGVPLLYENWNPGQPDSYFLSGENCVVMVWHDQGQWSDVPCNYHLSYTCKMGLVS
CGPPPELPLAQVFGRPRLRYEVDTVLRYRCREGLAQRNLPLIRCQENGRWEAPQISCVPRRPARALHPEEDPEG
RQGRLLGRWKALLIPPSSPMPGP
```

Signal peptide.
amino acids 1-15
N-glycosylation sites.
amino acids 130-133, 337-340
Tyrosine kinase phosphorylation sites.
amino acids 128-135, 451-459
N-myristoylation sites.
amino acids 47-52, 50-55, 133-138, 142-147, 174-179, 183-188, 281-286, 288-293, 297-302, 324-329, 403-408, 414-419, 415-420, 576-581, 586-591, 677-682, 684-689, 720-725, 772-777, 811-816
EGF-like domain cysteine pattern signature.
amino acids 670-682
C-type lectin domain signature.
amino acids 784-809
Immunoglobulins and major histocompatibility complex proteins signature.
amino acids 135-142
Link domain proteins.
amino acids 166-216, 264-314
Calcium-binding EGF-like domain proteins pattern proteins.
amino acids 655-676

FIGURE 90

MAQLFLPLLAALVLAQAPAALADVLEGDSSEDRAFRVRIAGDAPLQGVLGGALTIPCHVHYLRPPPSRRAVLGS
PRVKWTFLSRGREAEVLVARGVRVKVNEAYRFRVALPAYPASLTDVSLALSELRPNDSGIYRCEVQHGIDDSSD
AVEVKVKGVVFLYREGSARYAFSFSGAQEACARIGAHIATPEQLYAAYLGGYEQCDAGWLSDQTVRYPIQTPRE
ACYGDMDGFPGVRNYGVVDPDDLYDVYCYAEDLNGELFLGDPPEKLTLEEARAYCQERGAEIATTGQLYAAWDG
GLDHCSPGWLADGSVRYPIVTPSQRCGGGLPGVKTLFLFPNQTGFPNKHSRFNVYCFRDSAQPSAIPEASNPAS
NPASDGLEAIVTVTETLEELQLPQEATESESRGAIYSIPIMEDGGGGSSTPEDPAEAPRTLLEFETQSMVPPTG
FSEEEGKALEEEEKYEDEEEKEEEEEEEVEDEALWAWPSELSSPGPEASLPTEPAAQEESLSQAPARAVLQPG
ASPLPDGESEASRPPRVHGPPTETLPTPRERNLASPSPSTLVEAREVGEATGGPELSGVPRGESEETGSSEGAP
SLLPATRAPEGTRELEAPSEDNSGRTAPAGTSVQAQPVLPTDSASRGGVAVVPASGNSAQGSTALSILLLFFPL
QLWVT

Signal sequence.
amino acids 1-15

Transmembrane domain.
amino acids 652-670

N-glycosylation sites.
amino acids 130-133, 337-340

Tyrosine kinase phosphorylation sites.
amino acids 128-135, 451-459

N-myristoylation sites.
amino acids 47-52, 50-55, 133-138, 142-147, 174-179, 183-188, 281-286,
288-293, 297-302, 324-329, 403-408, 414-419, 415-420, 576-581, 586-591

Immunoglobulins and major histocompatibility complex.
amino acids 135-141

Extracellular link domain.
amino acids 156-251, 257-353

Immunoglobulin domain.
amino acids 50-139

FIGURE 91

MAVRQWVIALALAALLVVDREVPVAAGKLPFSRMPICEHMVESPTCSQMSNLVCGTDGLTYTNECQLCLARIKT
KQDIQIMKDGKC

Signal sequence.
amino acids 1-20

N-myristoylation site.
amino acids 58-63

Kazal-type serine protease inhibitor domain.
amino acids 37-86

FIGURE 92

MAPLCPSPWLPLLIPAPAPGLTVQLLLLSLLLLVPVHPQRLPRMQEDSPLGGGSSGEDDPLGEEDLPSEEDSPRE
EDPPGEEDLPGEEDLPGEEDLPEVKPKSEEEGSLKLEDLPTVEAPGDPQEPQNNAHRDKEGDDQSHWRYGGDPP
WPRVSPACAGRFQSPVDIRPQLAAFCPALRPLELLGFQLPPLPELRLRNNGHSVQLTLPPGLEMALGPGREYRA
LQLHLHWGAAGRPGSEHTVEGHRFPAEIHVVHLSTAFARVDEALGRPGGLAVLAAFLEEGPEENSAYEQLLSRL
EEIAEEGSETQVPGLDISALLPSDFSRYFRYEGSLTTPPCAQGVIWTVFNQTVMLSAKQLHTLSDTLWGPGDSR
LQLNFRATQPLNGRVIEASFPAGVDSSPRAAEPVQLNSCLAAGDILALVFGLLFAVTSVAFLVQMRRQHRRGTK
GGVSYRPAEVAETGA

Signal sequence.
amino acids 1-37

Transmembrane domain.
amino acids 409-429

N-glycosylation site.
amino acids 346-349 cAMP- and cGMP-dependent protein kinase phosphorylation site.
amino acids 440-443

N-myristoylation sites.
amino acids 50-55, 51-56, 209-214, 236-241, 310-315, 339-344, 421-426, 442-447

Eukaryotic-type carbonic anhydrases signature.
amino acids 237-253

Eukaryotic-type carbonic anhydrase.
amino acids 141-390

FIGURE 93

MDALQLANSAFAVDLFKQLCEKEPLGNVLFSPICLSTSLSLAQVGAKGDTANEIGQVLHFENVKDVPFGFQTVT
SDVNKLSSFYSLKLIKRLYVDKSLNLSTEFISSTKRPYAKELETVDFKDKLEETKGQINNSIKDLTDGHFENIL
ADNSVNDQTKILVVNAAYFVGKWMKKFSESETKECPFRVNKTDTKPVQMMNMEATFCMGNIDSINCKIIELPFQ
NKHLSMFILLPKDVEDESTGLEKIEKQLNSESLSQWTNPSTMANAKVKLSIPKFKVEKMIDPKACLENLGLKHI
FSEDTSDFSGMSETKGVALSNVIHKVCLEITEDGGDSIEVPGARILQHKDELNADHPFIYIIRHNKTRNIIFFG
KFCSP

Signal sequence.
amino acids 1-42

N-glycosylation sites.
amino acids 99-102, 133-136, 188-191, 361-364 cAMP- and cGMP-dependent protein kinase phosphorylation site.
amino acids 173-176

N-myristoylation sites.
amino acids 130-135, 207-212, 306-311, 312-317

Serpin (serine protease inhibitor).
amino acids 3-375

Fibrillarin proteins.
amino acids 150-169

FIGURE 94

MDRHSSYIFIWLQLELCAMAVLLTKGEIRCYCDAAHCVATGYMCKSELSACFSRLLDPQNSNSPLTHGCLDSLA
STTDICQAKQARNHSGTTIPTLECCHEDMCNYRGLHDVLSPPRGEASGQGNRYQHDGSRNLITKVQELTSSKEL
WFRAAVIAVPIAGGLILVLLIMLALRMLRSENKRLQDQRQQMLSRLHYSFHGHHSKKGQVAKLDLECMVPVSGH
ENCCLTCDKMRQADLSNDKILSLVHWGMYSGHGKLEFV

Signal sequence.

amino acids 1-26

Transmembrane domain.

amino acids 152-172

N-glycosylation site.

amino acids 87-90

Glycosaminoglycan attachment sites.

amino acids 121-124, 252-255

N-myristoylation sites.

amino acids 68-73, 249-254

FIGURE 95

```
MRNRRNDTLDSTRTLYSSASRSTDLSYSESDLVNFIQANFKKRECVFFTKDSKATENVCKCGYAQSQHMEGTQI
NQSEKWNYKKHTKEFPTDAFGDIQFETLGKKGKYIRLSCDTDAEILYELLTQHWHLKTPNLVISVTGGAKNFAL
KPRMRKIFSRLIYIAQSKGAWILTGGTHYGLTKYIGEVVRDNTISRSSEENIVAIGIAAWGMVSNRDTLIRNCD
AEGYFLAQYLMDDFTRDPLYILDNNHTHLLLVDNGCHGHPTVEAKLRNQLEKHISERTIQDSNYGGKIPIVCFA
QGGGKETLKAINTSIKNKIPCVVVEGSGRIADVIASLVEVEDAPTSSAVKEKLVRFLPRTVSRLSEEETESWIK
WLKEILECSHLLTVIKMEEAGDEIVSNAISYALYKAFSTSEQDKDNWNGQLKLLLEWNQLDLANDEIFTNDRRW
ESADLQEVMFTALIKDRPKFVRLFLENGLNLRKFLTHDVLTELFSNHFSTLVYRNLQIAKNSYNDALLTFVWKL
VANFRRGFRKEDRNGRDEMDIELHDVSPITRHPLQALFIWAILQNKKELSKVIWEQTRGCTLAALGASKLLKTL
AKVKNDINAAGESEELANEYETRAVELFTECYSSDEDLAEQLLVYSCEAWGGSNCLELAVEATDQHFTAQPGVQ
NFLSKQWYGEISRDTKNWKIILCLFIIPLVGCGFVSFRKKPVDKHKKLLWYYVAFFTSPFVVFSWNVVFYIAFL
LLFAYVLLMDFHSVPHPPELVLYSLVFVLFCDEVRQWYVNGVNYFTDLWNVMDTLGLFYFIAGIVFRLHSSNKS
SLYSGRVIFCLDYIIFTLRLIHIFTVSRNLGPKIIMLQRMLIDVFFFLFLFAVWMVAFGVARQGILRQNEQRWR
WIFRSVIYEPYLAMFGQVPSDVDGTTYDFAHCTFTGNESKPLCVELDEHNLPRFPEWITIPLVCIYMLSTNILL
VNLLVAMFGYTVGTVQENNDQVWKFQRYFLVQEYCSRLNIPFPFIVFAYFYMVVKKCFKCCCKEKNMESSVCCF
KNEDNETLAWEGVMKENYLVKINTKANDTSEEMRHRFRQLDTKLNDLKGLLKEIANKIK
```

Transmembrane domains.

amino acids 681-701, 718-738, 734-754, 757-777, 784-804, 819-839, 853-873, 951-971, 995-1015

N-glycosylation sites.

amino acids 6-9, 75-78, 247-250, 308-311, 812-815, 925-928, 1041-1044, 1063-1066 cAMP- and cGMP-dependent protein kinase phosphorylation site.

amino acids 83-86

Tyrosine kinase phosphorylation sites.

amino acids 21-27, 219-226, 279-286

N-myristoylation sites.

amino acids 71-76, 141-146, 174-179, 209-214, 299-304, 577-582, 643-648, 904-909

Amidation site.

amino acids 102-105

FIGURE 96

MRNRRNDTLDSTRTLYSSASRSTDLSYSESDLVNFIQANFKKRECVFFTKDSKATENVCKCGYAQSQHMEGTQI
NQSEKWNYKKHTKEFPTDAFGDIQFETLGKKGKYIRLSCDTDAEILYELLTQHWHLKTPNLVISVTGGAKNFAL
KPRMRKIFSRLIYIAQSKGAWILTGGTHYGLMKYIGEVVRDNTISRSSEENIVAIGIAAWGMVSNRDTLIRNCD
AEGYFLAQYLMDDFTRDPLYILDNNHTHLLLVDNGCHGHPTVEAKLRNQLEKYISERTIQDSNYGGKIPIVCFA
QGGGKETLKAINTSIKNKIPCVVVEGSGQIADVIASLVEVEDALTSSAVKEKLVRFLPRTVSRLPEEETESWIK
WLKEILECSHLLTVIKMEEAGDEIVSNAISYALYKAFSTSEQDKDNWNGQLKLLLEWNQLDLANDEIFTNDRRW
ESADLQEVMFTALIKDRPKFVRLFLENGLNLRKFLTHDVLTELFSNHFSTLVYRNLQIAKNSYNDALLTFVWKL
VANFRRGFRKEDRNGRDEMDIELHDVSPITRHPLQALFIWAILQNKKELSKVIWEQTRGCTLAALGASKLLKTL
AKVKNDINAAGESEELANEYETRAVELFTECYSSDEDLAEQLLVYSCEAWGGSNCLELAVEATDQHFIAQPGVQ
NFLSKQWYGEISRDTKNWKIILCLFIIPLVGCGFVSFRKKPVDKHKKLLWYYVAFFTSPFVVFSWNVVFYIAFL
LLFAYVLLMDFHSVPHPPELVLYSLVFVLFCDEVRQWYVNGVNYFTDLWNVMDTLGLFYFIAGIVFRLHSSNKS
SLYSGRVIFCLDYIIFTLRLIHIFTVSRNLGPKIIMLQRMLIDVFFFLFLFAVWMVAFGVARQGILRQNEQRWR
WIFRSVIYEPYLAMFGQVPSDVDGTTYDFAHCTFTGNESKPLCVELDEHNLPRFPEWITIPLVCIYMLSTNILL
VNLLVAMFGYTVGTVQENNDQVWKFQRYFLVQEYCSRLNIPFPFIVFAYFYMVVKKCFKCCCKEKNMESSVCCF
KNEDNETLAWEGVMKENYLVKINTKANDTSEEMRHRFRQLDTKLNDLKGLLKEIANKIK

Transmembrane domains.
amino acids 681-701, 718-738, 734-754, 757-777, 784-804, 819-839, 853-873, 951-971, 995-1015

N-glycosylation sites.
amino acids 6-9, 75-78, 247-250, 308-311, 812-815, 925-928, 1041-1044, 1063-1066 cAMP- and cGMP-dependent protein kinase phosphorylation site.
amino acids 83-86

Tyrosine kinase phosphorylation sites.
amino acids 21-27, 219-226, 279-286

N-myristoylation sites.
amino acids 71-76, 141-146, 174-179, 209-214, 299-304, 577-582, 643-648, 904-909

Amidation site.
amino acids 102-105

FIGURE 97

RRGRGEVLAVERGSGSGGGGTRSGWPAPAAGADKKPSRCGSGREGEGVSEGHKSMTGLYELVWRVLHALLCLHR
TLTSWLRVRFGTWNWIWRRCCRAASAAVLAPLGFTLRKPPAVGRNRRHHRHPRGGSCLAAAHHRMRWRADGRSL
EKLPVHMGLVITEVEQEPSFSDIASLVVWCMAVGISYISVYDHQGIFKRNNSRLMDEILKQQQELLGLDCSKYS
PEFANSNDKDDQVLNCHLAVKVLSPEDGKADIVRAAQDFCQLVAQKQRRPTDLDVDTLASLLSSNGCPDPDLVL
KFGPVDSTLGFLPWHIRLTEIVSLPSHLNISYEDFFSALRQYAACEQRLGK

Transmembrane domain.
amino acids 166-186

N-glycosylation sites.
amino acids 198-201, 325-328

Glycosaminoglycan attachment sites.
amino acids 14-17, 16-19 cAMP- and cGMP-dependent protein kinase phosphorylation sites.
amino acids 34-37, 270-273

N-myristoylation sites.
amino acids 13-18, 15-20, 17-22, 19-24, 20-25, 47-52, 129-134, 156-161, 215-220

FIGURE 98

MTGLYELVWRVLHALLCLHRTLTSWLRVRFGTWNWIWRRCCRAASAAVLAPLGFTLRKPPAVGRNRRHHRHPRG
GSCLAAAHHRMRWRADGRSLEKLPVHMGLVITEVEQEPSFSDIASLVVWCMAVGISYISVYDHQGIFKRNNSRL
MDEILKQQQELLGLDCSKYSPEFANSNDKDDQVLNCHLAVKVLSPEDGKADIVRAAQDFCQLVAQKQKRPTDLD
VDTLASLLSSNGCPDPDLVLKFGPVDSTLGFLPWHIRLTEIVSLPSHLNISYEDFFSALRQYAACEQRLGK

Signal sequence.

amino acids 1-23

Transmembrane domain.

amino acids 115-132

N-glycosylation sites.

amino acids 144-147, 271-274 cAMP- and cGMP-dependent protein kinase phosphorylation site.

amino acids 216-219

N-myristoylation sites.

amino acids 75-80, 102-107, 161-166

FIGURE 99

```
MVQRLWVSRLLRHRKAQLLLVNLLTFGLEVCLAAGITYVPPLLLEVGVEEKFMTMVLGIGPVLGLVCVPLLGSA
SDHWRGRYGRRRPFIWALSLGILLSLFLIPRAGWLAGLLCPDPRPLELALLILGVGLLDFCGQVCFTPLEALLS
DLFRDPDHCRQAYSVYAFMISLGGCLGYLLPAIDWDTSALAPYLGTQEECLFGLLTLIFLTCVAATLLVAEEAA
LGPTEPAEGLSAPSLSPHCCPCRARLAFRNLGALLPRLHQLCCRMPRTLRRLFVAELCSWMALMTFTLFYTDFV
GEGLYQGVPRAEPGTEARRHYDEGVRMGSLGLFLQCAISLVFSLVMDRLVQRFGTRAVYLASVAAFPVAAGATC
LSHSVAVVTASAALTGFTFSALQILPYTLASLYHREKQVFLPKYRGDTGGASSEDSLMTSFLPGPKPGAPFPNG
HVGAGGSGLLPPPPALCGASACDVSVRVVVGEPTEARVVPGRGICLDLAILDSAFLLSQVAPSLFMGSIVQLSQ
SVTAYMVSAAGLGLVAIYFATQVVFDKSDLAKYSA
```

Signal sequence.
amino acids 1-35

Transmembrane domains.
amino acids 15-35, 52-72, 87-107, 122-142, 160-180, 240-260, 277-297, 321-341, 486-506, 521-541

N-myristoylation sites.
amino acids 27-32, 95-100, 171-176, 299-304, 303-308, 320-325, 419-424, 447-452, 462-467

Amidation site.
amino acids 82-85

Cell attachment sequence.
amino acids 415-417

FIGURE 100

MALRRLGAALLLLPLLAAVEETLMDSTTATAELGWMVHPPSGWEEVSGYDENMNTIRTYQVCNVFESSQNNWLR
TKFIRRRGAHRIHVEMKFSVRDCSSIPSVPGSCKETFNLYYYEADFDSATKTFPNWMENPWVKVDTIAADESFS
QVDLGGRVMKINTEVRSFGPVSRSGFYLAFQDYGGCMSLIAVRVFYRKCPRIIQNGAIFQETLSGAESTSLVAA
RGSCIANAEEVDVPIKLYCNGDGEWLVPIGRCMCKAGFEAVENGTVCRGCPSGTFKANQGDEACTHCPINSRTT
SEGATNCVCRNGYYRADLDPLDMPCTTIPSAPQAVISSVNETSLMLEWTPPRDSGGREDLVYNIICKSCGSGRG
ACTRCGDNVQYAPRQLGLTEPRIYISDLLAHTQYTFEIQAVNGVTDQSPFSPQFASVNITTNQAAPSAVSIMHQ
VSRTVDSITLSWSQPDQPNGVILDYELQYYEKELSEYNATAIKSPTNTVTVQGLKAGAIYVFQVRARTVAGYGR
YSGKMYFQTMTEAEYQTSIQEKLPLIIGSSAAGLVFLIAVVVIAIVCNRRRGFERADSEYTDKLQHYTSGHMTP
GMKIYIDPFTYEDPNEAVREFAKEIDISCVKIEQVIGAGEFGEVCSGHLKLPGKREIFVAIKTLKSGYTEKQRR
DFLSEASIMGQFDHPNVIHLEGVVTKSTPVMIITEFMENGSLDSFLRQNDGQFTVIQLVGMLRGIAAGMKYLAD
MNYVHRDLAARNILVNSNLVCKVSDFGLSRFLEDDTSDPTYTSALGGKIPIRWTAPEAIQYRKFTSASDVWSYG
IVMWEVMSYGERPYWDMTNQDVINAIEQDYRLPPPMDCPSALHQLMLDCWQKDRNHRPKFGQIVNTLDKMIRNP
NSLKAMAPLSSGINLPLLDRTIPDYTSFNTVDEWLEAIKMGQYKESFANAGFTSFDVVSQMMMEDILRVGLTLA
GHQKKILNSIQVMRAQMNQIQSVEV

Signal sequence.
amino acids 1-18
Transmembrane domain.
amino acids 542-562
N-glycosylation sites.
amino acids 265-268, 336-339, 428-431, 482-485, 705-708
Glycosaminoglycan attachment site.
amino acids 367-370
cAMP- and cGMP-dependent protein kinase phosphorylation site.
amino acids 802-805
Tyrosine kinase phosphorylation sites.
amino acids 374-381, 595-603, 736-743
N-myristoylation sites.
amino acids 182-187, 213-218, 224-229, 271-276, 275-280, 299-304, 366-371,
497-502, 546-551, 706-711, 726-731, 730-735, 875-880, 958-963
Amidation site - amino acids 644-647
Tyrosine protein kinases specific active-site signature - amino acids 743-755
Receptor tyrosine kinase class V signature 1 - amino acids 182-198
Receptor tyrosine kinase class V signature 2 - amino acids 241-261
Ephrin receptor ligand binding domain - amino acids 20-197
Protein kinase domain - amino acids 622-881
Fibronectin type III domain - amino acids 325-421, 436-520
SAM domain (Sterile alpha motif) - amino acids 912-976

FIGURE 101

```
MALRRLGAALLLLPLLAAVEETLMDSTTATAELGWMVHPPSGWEEVSGYDENMNTIRTYQVCNVFESSQNNWLR
TKFIRRRGAHRIHVEMKFSVRDCSSIPSVPGSCKETFNLYYYEADFDSATKTFPNWMENPWVKVDTIAADESFS
QVDLGGRVMKINTEVRSFGPVSRSGFYLAFQDYGGCMSLIAVRVFYRKCPRIIQNGAIFQETLSGAESTSLVAA
RGSCIANAEEVDVPIKLYCNGDGEWLVPIGRCMCKAGFEAVENGTVCRGCPSGTFKANQGDEACTHCPINSRTT
SEGATNCVCRNGYYRADLDPLDMPCTTIPSAPQAVISSVNETSLMLEWTPPRDSGGREDLVYNIICKSCGSGRG
ACTRCGDNVQYAPRQLGLTEPRIYISDLLAHTQYTFEIQAVNGVTDQSPFSPQFASVNITTNQAAPSAVSIMHQ
VSRTVDSITLSWSQPDQPNGVILDYELQYYEKELSEYNATAIKSPTNTVTVQGLKAGAIYVFQVRARTVAGYGR
YSGKMYFQTMTEAEYQTSIQEKLPLIIGSSAAGLVFLIAVVVIAIVCNRRGFERADSEYTDKLQHYTSGHMTPG
MKIYIDPFTYEDPNEAVREFAKEIDISCVKIEQVIGAGEFGEVCSGHLKLPGKREIFVAIKTLKSGYTEKQRRD
FLSEASIMGQFDHPNVIHLEGVVTKSTPVMIITEFMENGSLDSFLRQNDGQFTVIQLVGMLRGIAAGMKYLADM
NYVHRDLAARNILVNSNLVCKVSDFGLSRFLEDDTSDPTYTSALGGKIPIRWTAPEAIQYRKFTSASDVWSYGI
VMWEVMSYGERPYWDMTNQDVINAIEQDYRLPPPMDCPSALHQLMLDCWQKDRNHRPKFGQIVNTLDKMIRNPN
SLKAMAPLSSGINLPLLDRTIPDYTSFNTVDEWLEAIKMGQYKESFANAGFTSFDVVSQMMMEDILRVGVTLAG
HQKKILNSIQVMRAQMNQIQSVEV
```

Signal sequence.
amino acids 1-18
Transmembrane domain.
amino acids 543-563
N-glycosylation sites.
amino acids 265-268, 336-339, 428-431, 482-485, 704-707
Glycosaminoglycan attachment site.
amino acids 367-370
cAMP- and cGMP-dependent protein kinase phosphorylation site.
amino acids 801-804
Tyrosine kinase phosphorylation sites.
amino acids 374-381, 594-602, 735-742
N-myristoylation sites.
amino acids 182-187, 213-218, 224-229, 271-276, 275-280, 299-304, 366-371, 497-502, 546-551, 705-710, 725-730, 729-734, 874-879, 957-962
Amidation site.
amino acids 643-646
Tyrosine protein kinases specific active-site signature.
amino acids 742-754
Receptor tyrosine kinase class V signature 1.
amino acids 182-198
Receptor tyrosine kinase class V signature 2.
amino acids 241-264
Ephrin receptor ligand binding domain.
amino acids 20-197
Protein kinase domain.
amino acids 621-880
Fibronectin type III domains.
amino acids 325-421, 436-520
SAM domain (Sterile alpha motif).
amino acids 911-975
Src homology 2 (SH2) domains.
amino acids 733-769, 787-797, 806-819

FIGURE 102

MNFSTSSSSFAYDREFLRTLPGFLIVAEIVLGLLVWTLIAGTEYFRVPAFGWVMFVAVFYWVLTVFFLIIYITM
TYTRIPQVPWTTVGLCFNGSAFVLYLSAAVVDASSVSPERDSHNFNSWAASSFFAFLVNICYAGNTYFSFIAWR
SRTIQ

Signal sequence.

amino acids 1-41

Transmembrane domains.

amino acids 53-73, 86-106, 122-142

N-glycosylation sites.

amino acids 2-5, 92-95

N-myristoylation site.

amino acids 88-93

Leucine zipper pattern.

amino acids 17-38

FIGURE 103

MNFSTSSSSFAYDREFLRTLPGFLIVAEIVLGLLVWTLIAGTEYFRVPAFGWVMFVAVFYWVLTVFFLIIYITM
TYTRIPQVPWTTVGLCFNGSAFVLYLSAAVVDASSVSPERDSHNFNSWAASSFFAFLVTICYAGNTYFSFIAWR
SRTIQ

Transmembrane domains.

amino acids 19-39, 53-73, 86-106, 122-142

N-glycosylation sites.

amino acids 2-5, 92-95

N-myristoylation site.

amino acids 88-93

Leucine zipper pattern.

amino acids 17-38

FIGURE 104

MPTTVDDVLEHGGEFHFFQKQMFFLLALLSATFAPIYVGIVFLGFTPDHRCRSPGVAELSLRCGWSPAEELNYT
VPGPGPAGEASPRQCRRYEVDWNQSTFDCVDPLASLDTNRSRLPLGPCRDGWVYETPGSSIVTEFNLVCANSWM
LDLFQSSVNVGFFIGSMSIGYIADRFGRKLCLLTTVLINAAAGVLMAISPTYTWMLIFRLIQGLVSKAGWLIGY
ILITEFVGRRYRRTVGIFYQVAYTVGLLVLAGVAYALPHWRWLQFTVALPNFFFLLYYWCIPESPRWLISQNKN
AEAMRIIKHIAKKNGKSLPASLQRLRLEEETGKKLNPSFLDLVRTPQIRKHTMILMYNWFTSSVLYQGLIMHMG
LAGDNIYLDFFYSALVEFPAAFMIILTIDRIGRRYPWAASNMVAGAACLASVFIPGDLQWLKIIISCLGRMGIT
MAYEIVCLVNAELYPTFIRNLGVHICSSMCDIGGIITPFLVYRLTNIWLELPLMVFGVLGLVAGGLVLLLPETK
GKALPETIEEAENMQRPRKNKEKMIYLQVQKLDIPLN

Transmembrane domains.

amino acids 20-40, 174-194, 205-225, 238-258, 269-289, 351-371, 376-396, 412-432, 492-512

N-glycosylation sites.

amino acids 72-75, 97-100, 113-116 cAMP- and cGMP-dependent protein kinase phosphorylation site.

amino acids 345-348

Tyrosine kinase phosphorylation site.

amino acids 536-553

N-myristoylation sites.

amino acids 191-196, 254-259, 442-447, 466-471, 504-509

Amidation site.

amino acids 174-177, 229-232, 327-330, 401-404

Sugar (and other) transporter.

amino acids 23-529

FIGURE 105

MPTTVDDVLEHGGEFHFFQKQMFFLLALLSATFAPIYVGIVFLGFTPDHRCRSPGVAELSLRCGWSPAEELNYT
VPGPGPAGEASPRQCRRYEVDWNQSTFDCVDPLASLDTNRSRLPLGPCRDGWVYETPGSSIVTEFNLVCANSWM
LDLFQSSVNVGFFIGSMSIGYIADRFGRKLCLLTTVLINAAAGVLMAISPTYTWMLIFRLIQGLVSKAGWLIGY
ILITEFVGRRYRRTVGIFYQVAYTVGLLVLAGVAYALPHWRWLQFTVSLPNFFFLLYYWCIPESPRWLISQNKN
AEAMRIIKHIAKKNGKSLPASLQRLRLEEETGKKLNPSFLDLVRTPQIRKHTMILMYNWFTSSVLYQGLIMHMG
LAGDNIYLDFFYSALVEFPAAFMIILTIDRIGRRYPWAASNMVAGAACLASVFIPGDLQWLKIIISCLGRMGIT
MAYEIVCLVNAELYPTFIRNLGVHICSSMCDIGGIITPFLVYRLTNIWLELPLMVFGVLGLVAGGLVLLLPETK
GKALPETIEEAENMQRPRKNKEKMIYLQVQKLDIPLN

Transmembrane domains.

amino acids 20-40, 174-194, 205-225, 238-258, 269-289, 351-371, 376-396, 412-432, 492-512

N-glycosylation sites.

amino acids 72-75, 97-100, 113-116 cAMP- and cGMP-dependent protein kinase phosphorylation site.

amino acids 345-348

Tyrosine kinase phosphorylation site.

amino acids 536-544

N-myristoylation sites.

amino acids 191-196, 254-259, 442-447, 466-471, 504-509

Amidation sites.

amino acids 174-177, 229-232, 327-330, 401-404

Sugar (and other) transporter.

amino acids 23-529

FIGURE 106

MAPWPELGDAQPNPDKYLEGAAGQQPTAPDKSKETNKTDNTEAPVTKIELLPSYSTATLIDEPTEVDDPWNLPT
LQDSGIKWSERDTKGKILCFFQGIGRLILLLGFLYFFVCSLDILSSAFQLVGGKMAGQFFSNSSIMSNPLLGLV
IGVLVTVLVQSSSTSTSIVVSMVSSSLLTVRAAIPIIMGANIGTSITNTIVALMQVGDRSEFRRAFAGATVHDF
FNWLSVLVLLPVEVATHYLEIITQLIVESFHFKNGEDAPDLLKVITKPFTKLIVQLDKKVISQIAMNDEKAKNK
SLVKIWCKTFTNKTQINVTVPSTANCTSPSLCWTDGIQNWTMKNVTYKENIAKCQHIFVNFHLPDLAVGTILLI
LSLLVLCGCLIMIVKILGSVLKGQVATVIKKTINTDFPFPFAWLTGYLAILVGAGMTFIVQSSSVFTSALTPLI
GIGVITIERAYPLTLGSNIGTTTTAILAALASPGNALRSSLQIALCHFFFNISGILLWYPIPFTRLPIRMAKGL
GNISAKYRWFAVFYLIIFFFLIPLTVFGLSLAGWRVLVGVGVPVVFIIILVLCLRLLQSRCPRVLPKKLQNWNF
LPLWMRSLKPWDAVVSKFTGCFQMRCCYCCRVCCRACCLLCGCPKCCRCSKCCEDLEEAQEGQDVPVKAPETFD
NITISREAQGEVPASDSKTECTAL

Transmembrane domains.
amino acids 96-116, 136-156, 178-198, 219-239, 356-376, 372-392, 406-426,
445-465, 488-508, 523-543, 549-569, 565-585, 592-612

N-glycosylation sites.
amino acids 36-39, 136-139, 295-298, 308-311, 313-316, 321-324, 335-338,
340-343, 495-498, 520-532, 667-670

N-myristoylation sites.
amino acids 23-28, 79-84, 126-131, 131-136, 146-151, 150-155, 187-192,
191-196, 393-398, 423-428, 460-465, 464-469, 519-524, 546-551, 634-639

4Fe-4S ferredoxins, iron-sulfur binding region signature.
amino acids 635-646

Insulin family signature.
amino acids 621-635

Heat-stable enterotoxins.
amino acids 617-633, 625-641, 613-629

Na+/Pi-cotransporter.
amino acids 118-549

FIGURE 107

MAPWPELGDAQPNPDKYLEGAAGQQPTAPDKSKETNKTDNTEAPVTKIELLPSYSTATLIDEPTEVDDPWNLPT
LQDSGIKWSERDTKGKILCFFQGIGRLILLLGFLYFFVCSLDILSSAFQLVGGKMAGQFFSNSSIMSNPLLGLV
IGVLVTVLVQSSSTSTSIVVSMVSSSLLTVRAAIPIIMGANIGTSITNTIVALMQVGDRSEFRRAFAGATVHDF
FNWLSVLVLLPVEVATHYLEIITQLIVESFHFKNGEDAPDLLKVITKPFTKLIVQLDKKVISQIAMNDEKAKNK
SLVKIWCKTFTNKTQINVTVPSTANCTSPSLCWTDGIQNWTMKNVTYKENIAKCQHIFVNFHLPDLAVGTILLI
LSLLVLCGCLIMIVKILGSVLKGQVATVIKKTINTDFPFPFAWLTGYLAILVGAGMTFIVQSSSVFTSALTPLI
GIGVITIERAYPLTLGSNIGTTTTAILAALASPGNALRSSLQIALCHFFFNISGILLWYPIPFTRLPIRMAKGL
GNISAKYRWFAVFYLIIFFFLIPLTVFGLSLAGWRVLVGVGVPVVFIIILVLCLRLLQSRCPRVLPKKLQNWNF
LPLWMRSLKPWDAVVSKFTGCFQMRCCCCCRVCCRACCLLCGCPKCCRCSKCCEDLEEAQEGQDVPVKAPETFD
NITISREAQGEVPASDSKTECTAL

Transmembrane domains.
amino acids 96-116, 136-156, 178-198, 219-239, 356-376, 372-392, 406-426,
445-465, 488-508, 523-543, 547-567, 563-583, 592-612

N-glycosylation sites.
amino acids 36-39, 136-139, 295-298, 308-311, 313-316, 321-324, 335-338,
340-343, 495-498, 520-523, 667-670

N-myristoylation sites.
amino acids 23-28, 79-84, 126-131, 131-136, 146-151, 150-155, 187-192,
191-196, 393-398, 423-428, 460-465, 464-469, 519-524, 546-551, 634-639

4Fe-4S ferredoxins, iron-sulfur binding region signature.
amino acids 635-645

Insulin family signature.
amino acids 621-635

Na+/Pi-cotransporter.
amino acids 118-549

FIGURE 108

MWSGWWLWPLVAVCTADFFRDEAERIMRDSPVIDGHNDLPWQLLDMFNNRLQDERANLTTLAGTHTNIPKLRAG
FVGGQFWSVYTPCDTQNKDAVRRTLEQMDVVHRMCRMYPETFLYVTSSAGIRQAFREGKVASLIGVEGGHSIDS
SLGVLRALYQLGMRYLTLTHSCNTPWADNWLVDTGDSEPQSQGLSPFGQRVVKELNRLGVLIDLAHVSVATMKA
TLQLSRAPVIFSHSSAYSVCASRRNVPDDVLRLVKQTDSLVMVNFYNNYISCTNKANLSQVADHLDHIKEVAGA
RAVGFGGDFDGVPRVPEGLEDVSKYPDLIAELLRRNWTEAEVKGALADNLLRVFQAVEQASNLTQAPEEEPIPL
DQLGGSCRTHYGYSSGASSLHRHWGLLLASLAPLVLCLSLL

Signal sequence.
amino acids 1-16

Transmembrane domain.
amino acids 392-410

N-glycosylation sites.
amino acids 57-60, 279-282, 332-335, 358-361

Tyrosine kinase phosphorylation site.
amino acids 110-118

N-myristoylation sites.
amino acids 63-68, 78-83, 124-129, 139-144, 151-156, 375-380, 395-400

Leucine zipper pattern.
amino acids 390-411

Renal dipeptidase active site.
amino acids 140-162

Renal dipeptidase.
amino acids 1-411

FIGURE 109

MSSCNFTHATFVLIGIPGLEKAHFWVGFPLLSMYVVAMFGNCIVVFIVRTERSLHAPMYLFLCMLAAIDLALST
STMPKILALFWFDSREISFEACLTQMFFIHALSAIESTILLAMAFDRYVAICHPLRHAAVLNNTVTAQIGIVAV
VRGSLFFFPLPLLIKRLAFCHSNVLSHSYCVHQDVMKLAYADTLPNVVYGLTAILLVMGVDVMFISLSYFLIIR
TVLQLPSKSERAKAFGTCVSHIGVVLAFYVPLIGLSVVHRFGNSLHPIVRVVMGDIYLLLPPVINPIIYGAKTK
QIRTRVLAMFKISCDKDLQAVGGK

Transmembrane domains.
amino acids 26-46, 57-77, 96-116, 144-164, 197-217, 238-258, 272-292

N-glycosylation sites.
amino acids 5-8, 136-139

N-myristoylation site.
amino acids 18-23, 238-243, 245-250

7 transmembrane receptor (rhodopsin family).
amino acids 40-131, 212-291

FIGURE 110A

```
MRILKRFLACIQLLCVCRLDWANGYYRQQRKLVEEIGWSYTGALNQKNWGKKYPTCNSPKQSPINIDEDLTQVN
VNLKKLKFQGWDKTSLENTFIHNTGKTVEINLTNDYRVSGGVSEMVFKASKITFHWGKCNMSSDGSEHSLEGQK
FPLEMQIYCFDADRFSSFEEAVKGKGKLRALSILFEVGTEENLDFKAIIDGVESVSRFGKQAALDPFILLNLLP
NSTDKYYIYNGSLTSPPCTDTVDWIVFKDTVSISESQLAVFCEVLTMQQSGYVMLMDYLQNNFREQQYKFSRQV
FSSYTGKEEIHEAVCSSEPENVQADPENYTSLLVTWERPRVVYDTMIEKFAVLYQQLDGEDQTKHEFLTDGYQD
LGAILNNLLPNMSYVLQIVAICTNGLYGKYSDQLIVDMPTDNPELDLFPELIGTEEIIKEEEEGKDIEEGAIVN
PGRDSATNQIRKKEPQISTTTHYNRIGTKYNEAKTNRSPTRGSEFSGKGDVPNTSLNSTSQPVTKLATEKDISL
TSQTVTELPPHTVEGTSASLNDGSKTVLRSPHMNLSGTAESLNTVSITEYEEESLLTSFKLDTGAEDSSGSSPA
TSAIPFISENISQGYIFSSENPETITYDVLIPESARNASEDSTSSGSEESLKDPSMEGNVWFPSSTDITAQPDV
GSGRESFLQTNYTEIRVDESEKTTKSFSAGPVMSQGPSVTDLEMPHYSTFAYFPTEVTPHAFTPSSRQQDLVST
VNVVYSQTTQPVYNGETPLQPSYSSEVFPLVTPLLLDNQILNTTPAASSSDSALHATPVFPSVDVSFESILSSY
DGAPLLPFSSASFSSELFRHLHTVSQILPQVTSATESDKVPLHASLPVAGGDLLLEPSLAQYSDVLSTTHAASE
TLEFGSESGVLYKTLMFSQVEPPSSDAMMHARSSGPEPSYALSDNEGSQHIFTVSYSSAIPVHDSVGVTYQGSL
FSGPSHIPIPKSSLITPTASLLQPTHALSGDGEWSGASSDSEFLLPDTDGLTALNISSPVSVAEFTYTTSVFGD
DNKALSKSEIIYGNETELQIPSFNEMVYPSESTVMPNMYDNVNKLNASLQETSVSISSTKGMFPGSLAHTTTKV
FDHEISQVPENNFSVQPTHTVSQASGDTSLKPVLSANSEPASSDPASSEMLSPSTQLLFYETSASFSTEVLLQP
SFQASDVDTLLKTVLPAVPSDPILVETPKVDKISSTMLHLIVSNSASSENMLHSTSVPVFDVSPTSHMHSASLQ
GLTISYASEKYEPVLLKSESSHQVVPSLYSNDELFQTANLEINQAHPPKGRHVFATPVLSIDEPLNTLINKLIH
SDEILTSTKSSVTGKVFAGIPTVASDTFVSTDHSVPIGNGHVAITAVSPHRDGSVTSTKLLFPSKATSELSHSA
KSDAGLVGGGEDGDTDDDGDDDDRDSDGLSIHKCMSCSSYRESQEKVMNDSDTHENSLMDQNNPISYSLSENS
EEDNRVTSVSSDSQTGMDRSPGKSPSANGLSQKHNDGKEENDIQTGSALLPLSPESKAWAVLTSDEESGSGQGT
SDSLNENETSTDFSFADTNEKDADGILAAGDSEITPGFPQSPTSSVTSENSEVFHVSEAEASNSSHESRIGLAE
GLESEKKAVIPLVIVSALTFICLVVLVGILIYWRKCFQTAHFYLEDSTSPRVISTPPTPIFPISDDVGAIPIKH
FPKHVADLHASSGFTEEFETLKEFYQEVQSCTVDLGITADSSNHPDNKHKNRYININIVAYDHSRVKLAQLAEKDG
KLTDYINANYVDGYNRPKAYIAAQGPLKSTAEDFWRMIWEHNVEVIVMITNLVEKGRRKCDQYWPADGSEEYGN
FLVTQKSVQVLAYYTVRNFTLRNTKIKKGSQKGRPSGRVVTQYHYTQWPDMGVPEYSLPVLTFVRKAAYAKRHA
VGPVVVHCSAGVGRTGTYIVLDSMLQQIQHEGTVNIFGFLKHIRSQRNYLVQTEEQYVFIHDTLVEAILSKETE
VLDSHIHAYVNALLIPGPAGKTKLEKQFQLLSQSNIQQSDYSAALKQCNREKNRTSSIIPVERSRVGISSLSGE
GTDYINASYIMGYYQSNEFIITQHPLLHTIKDFWRMIWDHNAQLVVMIPDGQNMAEDEFVYWPNKDEPINCESF
KVTLMAEEHKCLSNEEKLIIQDFILEATQDDYVLEVRHFQCPKWPNPDSPISKTFELISVIKEEAANRDGPMIV
HDEHGGVTAGTFCALTTLMHQLEKENSVDVYQVAKMINLMRPGVFADIEQYQFLYKVILSLVSTRQEENPSTSL
DSNGAALPDGNIAESLESLV
```

Signal sequence.

amino acids 1-19

Transmembrane domain.

amino acids 1638-1658

N-glycosylation sites.

amino acids 105-108, 134-137, 223-226, 232-235, 324-327, 381-384, 497-500, 501-504, 552-555, 602-605, 629-632, 677-680, 1017-1020, 1050-1053, 1082-1085, 1122-1125, 1456-1459, 1561-1564, 1617-1620, 1868-1871, 2051-2054, 2078-2081

Glycosaminoglycan attachment sites.

amino acids 490-493, 991-994, 1548-1551, 1550-1553, 2070-2073 cAMP- and cGMP-dependent protein kinase phosphorylation site.

amino acids 1877-1880

Tyrosine kinase phosphorylation site.

amino acids 148-156

FIGURE 110B

N-myristoylation sites.

amino acids 139-144, 186-191, 372-377, 471-476, 486-491, 533-538, 555-560, 582-587, 588-593, 638-643, 893-898, 960-965, 1097-1102, 1259-1264, 1385-1390, 1411-1416, 1415-1420, 1549-1554, 1551-1556, 1553-1558, 1579-1584, 1625-1630, 1879-1884, 1935-1940, 2123-2128, 2225-2230, 2226-2231, 2230-2235

Amidation sites.

amino acids 49-52, 1831-1834

Tyrosine specific protein phosphatases active site.

amino acids 1930-1942

Protein-tyrosine phosphatase.

amino acids 1749-1990, 2047-2280

Eukaryotic-type carbonic anhydrase.

amino acids 38-300

Fibronectin type III domain.

amino acids 312-401

MAM domain proteins.

amino acids 1757-1785, 1060-1088, 1813-1853, 2047-2079

FIGURE 111

MCARMAGRTRAAPRGPYGPWLCLLVALALDVVRVDCGQAPLDPVYLHVTAARPAQPTLWTAKLDRFKGSRHHTT
LITCHRAGLTEPDSSSPLELSEFLWVDFVVENSTGGGVAVTRPVTWQLEYPGQAPEAEKDKMVWEILVSERDIR
ALIPLAKAEELVNTAPLTGVPQHVPVRLVTVDGGGALVEVTEHVGCESANTQVLQVSEACDAVFVAGKESRGAR
GVRVDFWWRRLRASLRLTVWAPLLPLRIELTDTTLEQVRGWRVPGPAEGPAEPAAEASDEAERRARGCHLQYQR
AGVRFLAPFAAHPLDGGRRLTHLLGPDWLLDVSHLVAPHARVLDSRVASLEGGRVVVGREPGVTSIEVRSPLSD
SILGEQALAVTDDKVSVLELRVQPVMGISLTLSRGTAHPGEVTATCWAQSALPAPKQEVALSLWLSFSDHTVAP
AELYDRRDLGLSVSAEEPGAILPAEEQGAQLGVVVSGAGAEGLPLHVALHPPEPCRRGRHRVPLASGTAWLGLP
PASTPAPALPSSPAWSPPATEATMGGKRQVAGSVGGNTGVRGKFERAEEEARKEETEAREEEEEEEEMVPAPQ
HVTELELGMYALLGVFCVAIFIFLVNGVVFVLRYQRKEPPDSATDPTSPQPHNWVWLGTDQEELSRQLDRQSPG
PPKGEGSCPCESGGGGEAPTLAPGPPGGTTSSSSTLARKEAGGRRKRVEFVTFVPAPPAQSPEEPVGAPAVQSI
LVAGEEDIRWVCEDMGLKDPEELRNYMERIRGSS

N-glycosylation site.
amino acids 106-109

Glycosaminoglycan attachment sites.
amino acids 480-483, 678-681 cAMP- and cGMP-dependent protein kinase phosphorylation site.
amino acids 314-317

Tyrosine kinase phosphorylation site.
amino acids 758-766

N-myristoylation sites.
amino acids 109-114, 111-116, 193-198, 397-402, 454-459, 472-477, 476-481,
516-521, 550-555, 553-558, 672-677, 693-698, 694-694

Amidation sites.
amino acids 312-315, 543-546, 708-711

FIGURE 112

MATKTELSPTARESKNAQDMQVDETLIPRKGPSLCSARYGIALVLHFCNFTTIAQNVIMNITMVAMVNSTSPQS
QLNDSSEVLPVDSFGGLSKAPKSLPAKSSILGGQFAIWEKWGPPQERSRLCSIALSGMLLGCFTAILIGGFISE
TLGWPFVFYIFGGVGCVCCLLWFVVIYDDPFSYPWISTSEKEYIISSLKQQVGSSKQPLPIKAMLRSLPIWSIC
LGCFSHQWLVSTMVVYIPTYISSVYHVNIRDNGLLSALPFIVAWVIGMVGGYLADFLLTKKFRLITVRKIATIL
GSLPSSALIVSLPYLNSGYITATALLTLSCGLSTLCQSGIYINVLDIAPRYSSFLMGASRGFSSIAPVIVPTVS
GFLLSQDPEFGWRNVFFLLFAVNLLGLLFYLIFGEADVQEWAKERKLTRL

Transmembrane domains.

amino acids 124-144, 154-174, 255-275, 287-307, 319-339, 350-370, 385-405

N-glycosylation sites.

amino acids 49-52, 60-63, 68-71, 77-80 cAMP- and cGMP-dependent protein kinase phosphorylation site.

amino acids 415-418

N-myristoylation sites.

amino acids 106-111, 131-136, 135-140, 143-148, 160-165, 163-168, 255-260, 269-274, 272-277, 297-302, 335-340, 353-358

FIGURE 113

MQVDETLIPRKVPSLCSARYGIALVLHFCNFTTIAQNVIMNITMVAMVNSTSPQSQLNDSSEVLPVDSFGGLSK
APKSLPTKSSILGGQFAIWEKWGPPQERSRLCSIALSGMLLGCFTAILIGGFISETLGWPFVFYIFGGVGCVCC
LLWFVVIYDDPVSYPWISTSEKEYIISSLKQQVRSSKQPLPIKAMLRSLPIWSICLGCFSHQWLVSTMVVYIPT
YISSVYHVNIRDNGLLSALPFIVAWVIGMVGGYLADFLLTKKFRLITVRKIATILGSLPSSALIVSLPYLNSGY
ITATALLTLSCGLSTLCQSGIYINVLDIAPRYSSFLMGASRGFSSIAPVIVPTVSGFLLSQDPEFGWRNVFFLL
FAVNLLGLLFYLIFGEADVQEWAKERKLTRL

Transmembrane domains.
amino acids 22-42, 105-125, 137-157, 236-256, 268-288, 300-320, 331-351, 366-386

N-glycosylation sites.
amino acids 30-33, 41-44, 49-52, 58-61 cAMP- and cGMP-dependent protein kinase phosphorylation site.
amino acids 396-399

N-myristoylation sites.
amino acids 87-92, 112-117, 116-121, 124-129, 141-146, 144-149, 236-241, 250-255, 253-258, 278-283, 316-321, 334-339

FIGURE 114

MAGAGPKRRALAAPAAEEKEEAREKMLAAKSADGSAPAGEGEGVTLQRNITLLNGVAIIVGTIIGSGIFVTPTG
VLKEAGSPGLALVVWAACGVFSIVGALCYAELGTTISKSGGDYAYMLEVYGSLPAFLKLWIELLIIRPSSQYIV
ALVFATYLLKPLFPTCPVPEEAAKLVACLCVLLLTAVNCYSVKAATRVQDAFAAAKLLALALIILLGFVQIGKG
DVSNLDPKFSFEGTKLDVGNIVLALYSGLFAYGGWNYLNFVTEEMINPYRNLPLAIIISLPIVTLVYVLTNLAY
FTTLSTEQMLSSEAVAVDFGNYHLGVMSWIIPVFVGLSCFGSVNGSLFTSSRLFFVGSREGHLPSILSMIHPQL
LTPVPSLVFTCVMTLLYAFSKDIFSVINFFSFFNWLCVALAIIGMIWLRHRKPELERPIKVNLALPVFFILACL
FLIAVSFWKTPVECGIGFTIILSGLPVYFFGVWWKNKPKWLLQGIFSTTVLCQKLMQVVPQET

Transmembrane domains.
amino acids 48-68, 83-103, 120-140, 137-157, 165-185, 200-220, 236-256, 274-294, 316-336, 364-384, 394-414, 430-450

N-glycosylation sites.
amino acids 49-52, 340-343

Tyrosine kinase phosphorylation site.
amino acids 112-119

N-myristoylation sites.
amino acids 34-39, 61-66, 107-112, 114-119, 125-130, 337-342, 341-346, 353-358, 459-464, 488-493

Amino acid permease.
amino acids 46-481

FIGURE 115

MAGAGPKRRALAAPAAEEKEEAREKMLAAKSADGSAPAGEGEGVTLQRNITLLNGVAIIVGTIIGSGIFVTPTG
VLKEAGSPGLALVVWAACGVFSIVGALCYAELGTTISKSGGDYAYMLEVYGSLPAFLKLWIELLIIRPSSQYIV
ALVFATYLLKPLFPTCPVPEEAAKLVACLCVLLLTAVNCYSVKAATRVQDAFAAAKLLALALIILLGFVQIGKG
DVSNLDPNFSFEGTKLDVGNIVLALYSGLFAYGGWNYLNFVTEEMINPYRNLPLAIIISLPIVTLVYVLTNLAY
FTTLSTEQMLSSEAVAVDFGNYHLGVMSWIIPVFVGLSCFGSVNGSLFTSSRLFFVGSREGHLPSILSMIHPQL
LTPVPSLVFTCVMTLLYAFSKDIFSVINFFSFFNWLCVALAIIGMIWLRHRKPELERPIKVNLALPVFFILACL
FLIAVSFWKTPVECGIGFTIILSGLPVYFFGVWWKNKPKWLLQGIFSTTVLCQKLMQVVPQET

Transmembrane domains.
amino acids 48-68, 83-103, 120-140, 137-157, 165-185, 199-219, 236-256, 274-294, 316-336, 364-384, 394-414, 430-450

N-glycosylation sites.
amino acids 49-52, 230-233, 340-343

Tyrosine kinase phosphorylation site.
amino acids 112-119

N-myristoylation sites.
amino acids 34-39, 61-66, 107-112, 114-119, 125-130, 337-342, 341-346, 353-358, 459-464, 488-493

Amino acid permeases.
amino acids 46-481

FIGURE 116

MALPTARPLLGSCGTPALGSLLFLLFSLGWVQPSRTLAGETGQEAAPLDGVLANPPNISSLSPRQLLGFPCAEV
SGLSTERVRELAVALAQKNVKLSTEQLRCLAHRLSEPPEDLDALPLDLLLFLNPDAFSGPQACTRFFSRITKAN
VDLLPRGAPERQRLLPAALACWGVRGSLLSEADVRALGGLACDLPGRFVAESAEVLLPRLVSCPGPLDQDQQEA
ARAALQGGGPPYGPPSTWSVSTMDALRGLLPVLGQPIIRSIPQGIVAAWRQRSSRDPSWRQPERTILRPRFRRE
VEKTACPSGKKAREIDESLIFYKKWELEACVDAALLATQMDRVNAIPFTYEQLDVLKHKLDELYPQGYPESVIQ
HLGYLFLKMSPEDIRKWNVTSLETLKALLEVNKGHEMSPQVATLIDRFVKGRGQLDKDTLDTLTAFYPGYLCSL
SPEELSSVPPSSIWAVRPQDLDTCDPRQLDVLYPKARLAFQNMNGSEYFVKIQSFLGGAPTEDLKALSQQNVSM
DLATFMKLRTDAVLPLTVAEVQKLLGPHVEGLKAEERHRPVRDWILRQRQDDLDTLGLGLQGGIPNGYLVLDLS
VQEALSGTPCLLGPGPVLTVLALLLASTLA

Signal sequence.

amino acids 1-33

Transmembrane domain.

amino acids 603-621

N-glycosylation sites.

amino acids 57-60, 388-391, 488-491, 515-518

Tyrosine kinase phosphorylation site.

amino acids 353-360, 471-477

N-myristoylation sites.

amino acids 171-176, 174-179, 186-191, 266-271, 501-506, 577-582, 580-585, 581-586

Amidation site.

amino acids 304-307

Leucine zipper pattern.

amino acids 101-122

FIGURE 117

MALPTARPLLGSCGTPALGSLLFLLFSLGWVQPSRTLAGETGQEAAPLDGVLANPPNISSLSPRQLLGFPCAEV
SGLSTERVRELAVALAQKNVKLSTEQLRCLAHRLSEPPEDLDALPLDLLLFLNPDAFSGPQACTRFFSRITKAN
VDLLPRGAPERQRLLPAALACWGVRGSLLSEADVRALGGLACDLPGRFVAESAEVLLPRLVSCPGPLDQDQQEA
ARAALQGGGPPYGPPSTWSVSTMDALRGLLPVLGQPIIRSIPQGIVAAWRQRSSRDPSWRQPERTILRPRFRRE
VEKTACPSGKKAREIDESLIFYKKWELEACVDAALLATQMDRVNAIPFTYEQLDVLKHKLDELYPQGYPESVIQ
HLGYLFLKMSPEDIRKWNVTSLETLKALLEVNKGHEMSPQVATLIDRFVKGRGQLDKDTLDTLTAFYPGYLCSL
SPEELSSVPPSSIWAVRPQDLDTCDPRQLDVLYPKARLAFQNMNGSEYFVKIQSFLGGAPTEDLKALSQQNVSM
DLATFMKLRTDAVLPLTVAEVQKLLGPHVEGLKAEERHRPVRDWILRQRQDDLDTLGLGLQGGIPNGYLVLDLS
VQEALSGTPCLLGPGPVLTVLALLLASTLA

Signal sequence.

amino acids 1-33

Transmembrane domain.

amino acids 603-621

N-glycosylation sites.

amino acids 57-60, 388-391, 488-491, 515-518

Tyrosine kinase phosphorylation sites.

amino acids 353-360, 471-477

N-myristoylation sites.

amino acids 171-176, 174-179, 186-191, 266-271, 501-506, 577-582, 580-585, 581-586

Amidation site.

amino acids 304-307

Leucine zipper pattern.

amino acids 101-122

FIGURE 118

MATTVPDGCRNGLKSKYYRLCDKAEAWGIVLETVATAGVVTSVAFMLTLPILVCKVQDSNRRKMLPTQFLFLLG
VLGIFGLTFAFIIGLDGSTGPTRFFLFGILFSICFSCLLAHAVSLTKLVRGRKPLSLLVILGLAVGFSLVQDVI
AIEYIVLTMNRTNVNVFSELSAPRRNEDFVLLLTYVLFLMALTFLMSSFTFCGSFTGWKRHGAHIYLTMLLSIA
IWVAWITLLMLPDFDRRWDDTILSSALAANGWVFLLAYVSPEFWLLTKQRNPMDYPVEDAFCKPQLVKKSYGVE
NRAYSQEEITQGFEETGDTLYAPYSTHFQLQNQPPQKEFSIPRAHAWPSPYKDYEVKKEGS

Transmembrane domains.

amino acids 30-50, 66-86, 98-118, 121-141, 137-157, 174-194, 212-232, 244-264

N-glycosylation site.

amino acids 158-161

N-myristoylation sites.

amino acids 8-13, 38-43, 80-85, 88-93, 102-107, 136-141, 201-206

Amidation site.

amino acids 124-127

7 transmembrane receptor.

amino acids 27-273

FIGURE 119

```
MIPFLPMFSLLLLLIVNPINANNHYDKILAHSRIRGRDQGPNVCALQQILGTKKKYFSTCKNWYKKSICGQKTT
VLYECCPGYMRMEGMKGCPAVLPIDHVYGTLGIVGATTTQRYSDASKLREEIEGKGSFTYFAPSNEAWDNLDSD
IRRGLESNVNVELLNALHSHMINKRMLTKDLKNGMIIPSMYNNLGLFINHYPNGVVTVNCARIIHGNQIATNGV
VHVIDRVLTQIGTSIQDFIEAEDDLSSFRAAAITSDILEALGRDGHFTLFAPTNEAFEKLPRGVLERFMGDKVA
SEALMKYHILNTLQCSESIMGGAVFETLEGNTIEIGCDGDSITVNGIKMVNKKDIVTNNGVIHLIDQVLIPDSA
KQVIELAGKQQTTFTDLVAQLGLASALRPDGEYTLLAPVNNAFSDDTLSMVQRLLKLILQNHILKVKVGLNELY
NGQILETIGGKQLRVFVYRTAVCIENSCMEKGSKQGRNGAIHIFREIIKPAEKSLHEKLKQDKRFSTFLSLLEA
ADLKELLTQPGDWTLFVPTNDAFKGMTSEEKEILIRDKNALQNIILYHLTPGVFIGKGFEPGVTNILKTTQGSK
IFLKEVNDTLLVNELKSKESDIMTTNGVIHVVDKLLYPADTPVGNDQLLEILNKLIKYIQIKFVRGSTFKEIPV
TVYTTKIITKVVEPKIKVIEGSLQPIIKTEGPTLTKVKIEGEPEFRLIKEGETITEVIHGEPIIKKYTKIIDGV
PVEITEKETREERIITGPEIKYTRISTGGGETEETLKKLLQEEVTKVTKFIEGGDGHLFEDEEIKRLLQGDTPV
RKLQANKKVQGSRRRLREGRSQ
```

Signal sequence.
amino acids 1-21

N-glycosylation site.
amino acids 599-602 cAMP- and cGMP-dependent protein kinase phosphorylation site.
amino acids 507-510, 731-734

N-myristoylation sites.
amino acids 70-75, 106-111, 109-114, 152-157, 193-198, 214-219, 392-397, 476-481, 570-575, 768-773

Fasciclin domain.
amino acids 94-232, 496-630

FIGURE 120

MIPFLPMFSLLLLLIVNPINANNHYDKILAHSRIRGRDQGPNVCALQQILGTKKKYFSTCKNWYKKSICGQKTT
VLYECCPGYMRMEGMKGCPAVLPIDHVYGTLGIVGATTTQRYSDASKLREEIEGKGSFTYFAPSNEAWDNLDSD
IRRGLESNVNVELLNALHSHMINKRMLTKDLKNGMIIPSMYNNLGLFINHYPNGVVTVNCARIIHGNQIATNGV
VHVIDRVLTQIGTSIQDFIEAEDDLSSFRAAAITSDILEALGRDGHFTLFAPTNEAFEKLPRGVLERIMGDKVA
SEALMKYHILNTLQCSESIMGGAVFETLEGNTIEIGCDGDSITVNGIKMVNKKDIVTNNGVIHLIDQVLIPDSA
KQVIELAGKQQTTFTDLVAQLGLASALRPDGEYTLLAPVNNAFSDDTLSMDQRLLKLILQNHILKVKVGLNELY
NGQILETIGGKQLRVFVYRTAVCIENSCMEKGSKQGRNGAIHIFREIIKPAEKSLHEKLKQDKRFSTFLSLLEA
ADLKELLTQPGDWTLFVPTNDAFKGMTSEEKEILIRDKNALQNIILYHLTPGVFIGKGFEPGVTNILKTTQGSK
IFLKEVNDTLLVNELKSKESDIMTTNGVIHVVDKLLYPADTPVGNDQLLEILNKLIKYIQIKFVRGSTFKEIPV
TVYRPTLTKVKIEGEPEFRLIKEGETITEVIHGEPIIKKYTKIIDGVPVEITEKETREERIITGPEIKYTRIST
GGGETEETLKKLLQEEVTKVTKFIEGGDGHLFEDEEIKRLLQGDTPVRKLQANKKVQGSRRRLREGRSQ

Signal sequence.
amino acids 1-21

N-glycosylation site.
amino acids 599-602 cAMP- and cGMP-dependent protein kinase phosphorylation site.
amino acids 507-510, 704-707

N-myristoylation sites.
amino acids 70-75, 106-111, 109-114, 152-157, 193-198, 214-219, 392-397, 476-481, 570-575, 741-746

Fasciclin domains.
amino acids 94-232, 234-367, 370-494, 496-630

FIGURE 121

```
MIPFLPMFSLLLLLIVNPINANNHYDKILAHSRIRGRDQGPNVCALQQILGTKKKYFSTCKNWYKKSICGQKTT
VLYECCPGYMRMEGMKGCPAVLPIDHVYGTLGIVGATTTQRYSDASKLREEIEGKGSFTYFAPSNEAWDNLDSD
IRRGLESNVNVELLNALHSHMINKRMLTKDLKNGMIIPSMYNNLGLFINHYPNGVVTVNCARIIHGNQIATNGV
VHVIDRVLTQIGTSIQDFIEAEDDLSSFRAAAITSDILEALGRDGHFTLFAPTNEAFEKLPRGVLERIMGDKVA
SEALMKYHILNTLQCSESIMGGAVFETLEGNTIEIGCDGDSITVNGIKMVNKKDIVTNNGVIHLIDQVLIPDSA
KQVIELAGKQQTTFTDLVAQLGLASALRPDGEYTLLAPVNNAFSDDTLSMDQRLLKLILQNHILKVKVGLNELY
NGQILETIGGKQLRVFVYRTAVCIENSCMEKGSKQGRNGAIHIFREIIKPAEKSLHEKLKQDKRFSTFLSLLEA
ADLKELLTQPGDWTLFVPTNDAFKGMTSEEKEILIRDKNALQNIILYHLTPGVFIGKGFEPGVTNILKTTQGSK
IFLKEVNDTLLVNELKSKESDIMTTNGVIHVVDKLLYPADTPVGNDQLLEILNKLIKYIQIKFVRGSTFKEIPV
TVYKPIIKKYTKIIDGVPVEITEKETREERIITGPEIKYTRISTGGGETEETLKKLLQEDTPVRKLQANKKVQG
SRRRLREGRSQ
```

Signal sequence.
amino acids 1-21

N-glycosylation site.
amino acids 599-602 cAMP- and cGMP-dependent protein kinase phosphorylation sites.
amino acids 507-510, 674-677

N-myristoylation sites.
amino acids 70-75, 106-111, 109-114, 152-157, 193-198, 214-219, 392-397, 476-481, 570-575, 711-716

Fasciclin domains.
amino acids 94-232, 234-367, 370-494, 496-630

FIGURE 122

MIPFLPMFSLLLLLIVNPINANNHYDKILAHSRIRGRDQGPNVCALQQILGTKKKYFSTCKNWYKKSICGQKTT
VLYECCPGYMRMEGMKGCPAVLPIDHVYGTLGIVGATTTQRYSDASKLREEIEGKGSFTYFAPSNEAWDNLDSD
IRRGLESNVNVELLNALHSHMINKRMLTKDLKNGMIIPSMYNNLGLFINHYPNGVVTVNCARIIHGNQIATNGV
VHVIDRVLTQIGTSIQDFIEAEDDLSSFRAAAITSDILEALGRDGHFTLFAPTNEAFEKLPRGVLERIMGDKVA
SEALMKYHILNTLQCSESIMGGAVFETLEGNTIEIGCDGDSITVNGIKMVNKKDIVTNNGVIHLIDQVLIPDSA
KQVIELAGKQQTTFTDLVAQLGLASALRPDGEYTLLAPVNNAFSDDTLSMDQRLLKLILQNHILKVKVGLNELY
NGQILETIGGKQLRVFVYRTAVCIENSCMEKGSKQGRNGAIHIFREIIKPAEKSLHEKLKQDKRFSTFLSLLEA
ADLKELLTQPGDWTLFVPTNDAFKGMTSEEKEILIRDKNALQNIILYHLTPGVFIGKGFEPGVTNILKTTQGSK
IFLKEVNDTLLVNELKSKESDIMTTNGVIHVVDKLLYPADTPVGNDQLLEILNKLIKYIQIKFVRGSTFKEIPV
TVYRPTLTKVKIEGEPEFRLIKEGETITEVIHGEPIIKKYTKIIDGVPVEITEKETREERIITGPEIKYTRIST
GGGETEETLKKLLQEDTPVRKLQANKKVQGSRRRLREGRSQ

Signal sequence.
amino acids 1-21

N-glycosylation site.
amino acids 599-602 cAMP- and cGMP-dependent protein kinase phosphorylation sites.
amino acids 507-510, 704-707

N-myristoylation sites.
amino acids 70-75, 106-111, 109-114, 152-157, 193-198, 214-219, 392-397, 476-481, 570-575, 741-746

Fasciclin domains.
amino acids 94-232, 234-367, 370-494, 496-630

FIGURE 123

```
MIPFLPMFSLLLLLIVNPINANNHYDKILAHSRIRGRDQGPNVCALQQILGTKKKYFSTCKNWYKKSICGQKTT
VLYECCPGYMRMEGMKGCPAVLPIDHVYGTLGIVGATTTQRYSDASKLREEIEGKGSFTYFAPSNEAWDNLDSD
IRRGLESNVNVELLNALHSHMINKRMLTKDLKNGMIIPSMYNNLGLFINHYPNGVVTVNCARIIHGNQIATNGV
VHVIDRVLTQIGTSIQDFIEAEDDLSSFRAAAITSDILEALGRDGHFTLFAPTNEAFEKLPRGVLERIMGDKVA
SEALMKYHILNTLQCSESIMGGAVFETLEGNTIEIGCDGDSITVNGIKMVNKKDIVTNNGVIHLIDQVLIPDSA
KQVIELAGKQQTTFTDLVAQLGLASALRPDGEYTLLAPVNNAFSDDTLSMDQRLLKLILQNHILKVKVGLNELY
NGQILETIGGKQLRVFVYRTAVCIENSCMEKGSKQGRNGAIHIFREIIKPAEKSLHEKLKQDKRFSTFLSLLEA
ADLKELLTQPGDWTLFVPTNDAFKGMTSEEKEILIRDKNALQNIILYHLTPGVFIGKGFEPGVTNILKTTQGSK
IFLKEVNDTLLVNELKSKESDIMTTNGVIHVVDKLLYPADTPVGNDQLLEILNKLIKYIQIKFVRGSTFKEIPV
TVYKPIIKKYTKIIDGVPVEITEKETREERIITGPEIKYTRISTGGGETEETLKKLLQEEVTKVTKFIEGGDGH
LFEDEEIKRLLQGDTPVRKLQANKKVQGSRRRLREGRSQ
```

Signal sequence.
amino acids 1-21

N-glycosylation site.
amino acids 599-602 cAMP- and cGMP-dependent protein kinase phosphorylation sites.
amino acids 507-510, 674-677

N-myristoylation sites.
amino acids 70-75, 106-111, 109-114, 152-157, 193-198, 214-219, 392-397, 476-481, 570-575, 711-716

Fasciclin domains.
amino acids 94-232, 234-367, 370-494, 496-630

FIGURE 124

MVNYAWAGRSQRKLWWRSVAVLTCKSVVRPGYRGGLQARRSTLLKTCARARATAPGAMKMVAPWTRFYSNSCCL
CCHVRTGTILLGVWYLIINAVVLLILLSALADPDQYNFSSSELGGDFEFMDDANMCIAIAISLLMILICAMATY
GAYKQRAAWIIPFFCYQIFDFALNMLVAITVLIYPNSIQEYIRQLPPNFPYRDDVMSVNPTCLVLIILLFISII
LTFKGYLISCVWNCYRYINGRNSSDVLVYVTSNDTTVLLPPYDDATVNGAAKEPPPPYVSA

Transmembrane domains.
amino acids 83-103, 124-144, 162-182, 205-225

N-glycosylation sites.
amino acids 111-114, 244-227, 255-258 cAMP- and cGMP-dependent protein kinase phosphorylation site.
amino acids 39-42

Tyrosine kinase phosphorylation site.
amino acids 243-251

N-myristoylation site.
amino acids 34-39

FIGURE 125

MPGQGGLQARRSTLLKTCARARATAPGAMKMVAPWTRFYSNSCCLCCHVRTGTILLGVWYLIINAVVLLILLSA
LADPDQYNFSSSELGGDFEFMDDANMCIAIAISLLMILICAMATYGAYKQRAAWIIPFFCYQIFDFALNMLVAI
TVLIYPNSIQEYIRQLPPNFPYRDDVMSVNPTCLVLIILLFISIILTFKGYLISCVWNCYRYINGRNSSDVLVY
VTSNDTTVLLPPYDDATVNGAAKEPPPPYVSA

Transmembrane domains.

amino acids 54-74, 95-115, 133-153, 176-196

N-glycosylation sites.

amino acids 82-85, 215-218, 226-229 cAMP- and cGMP-dependent protein kinase phosphorylation site.

amino acids 10-13

Tyrosine kinase phosphorylation site.

amino acids 214-222

N-myristoylation site.

amino acids 5-10

FIGURE 126

MGRAGGGGPGRGPPPLLLFLGAALVLASGAVPAREAGSAVEAEELVKGSPAWEPPANDTREEAGPPAAGEDEAS
WTAPGGELAGPEEVLQESAAVTGTAWLEADSPGLGGVTAEAGSGDAQALPATLQAPHEVLGQSIMPPAIPEATE
ASGPPSPTPGDKLSPASELPKESPLEVWLNLGGSTPDPQVPELTYPFQGTLEPQPASDIIDIDYFEGLDGEGRG
ADLGSFPGSPGTSENHPDTEGETPSWSLLDLYDDFTPFDESDFYPTTSFYDDLDEEEEEEEDDKDAVGGGDLED
ENELLVPTGKPGLGPGTGQPTSRWHAVPPQHTLGSVPGSSIALRPRPGEPGRDLASSENGTECRSGFVRHNGSC
RSVCDLFPSYCHNGGQCYLVENIGAFCRCNTQDYIWHKGMRCESIITDFQVMCVAVGSAALVLLLLFMMTVFFA
KKLYLLKTENTKLRRTNKFRTPSELHNDNFSLSTIAEGSHPNDDPSAPHKIQEVLKSCLKEEESFNIQNSMSPK
LEGGKGDQADLDVNCLQNNLT

Signal sequence.
amino acids 1-30

Transmembrane domain.
amino acids 423-443

N-glycosylation sites.
amino acids 57-60, 355-358, 367-370, 473-476

N-myristoylation sites.
amino acids 6-11, 29-34, 79-84, 109-114, 116-121, 222-227, 226-231, 230-235,
233-238, 308-313, 314-319, 330-335, 334-339, 368-373, 482-487

FIGURE 127

```
MLPVYQEVKPNPLQDANICSRVFFWWLNPLFKIGHKRRLEEDDMYSVLPEDRSQHLGEELQGFWDKEVLRAEND
AQKPSLTRAIIKCYWKSYLVLGIFTLIEESAKVIQPIFLGKIINYFENYDPMDSVALNTAYAYATVLTFCTLIL
AILHHLYFYHVQCAGMRLRVAMCHMIYRKALRLSNMAMGKTTTGQIVNLLSNDVNKFDQVTVFLHFLWAGPLQA
IAVTALLWMEIGISCLAGMAVLIILLPLQSCFGKLFSSLRSKTATFTDARIRTMNEVITGIRIIKMYAWEKSFS
NLITNLRKKEISKILRSSCLRGMNLASFFSASKIIVFVTFTTYVLLGSVITASRVFVAVTLYGAVRLTVTLFFP
SAIERVSEAIVSIRRIQTFLLLDEISQRNRQLPSDGKKMVHVQDFTAFWDKASETPTLQGLSFTVRPGELLAVV
GPVGAGKSSLLSAVLGELAPSHGLVSVHGRIAYVSQQPWVFSGTLRSNILFGKKYEKERYEKVIKACALKKDLQ
LLEDGDLTVIGDRGTTLSGGQKARVNLARAVYQDADIYLLDDPLSAVDAEVSRHLFELCICQILHEKITILVTH
QLQYLKAASQILILKDGKMVQKGTYTEFLKSGIDFGSLLKKDNEESEQPPVPGTPTLRNRTFSESSVWSQQSSR
PSLKDGALESQDTENVPVTLSEENRSEGKVGFQAYKNYFRAGAHWIVFIFLILLNTAAQVAYVLQDWWLSYWAN
KQSMLNVTVNGGGNVTEKLDLNWYLGIYSGLTVATVLFGIARSLLVFYVLVNSSQTLHNKMFESILKAPVLFFD
RNPIGRILNRFSKDIGHLDDLLPLTFLDFIQTLLQVVGVVSVAVAVIPWIAIPLVPLGIIFIFLRRYFLETSRD
VKRLESTTRSPVFSHLSSSLQGLWTIRAYKAEERCQELFDAHQDLHSEAWFLFLTTSRWFAVRLDAICAMFVII
VAFGSLILAKTLDAGQVGLALSYALTLMGMFQWCVRQSAEVENMMISVERVIEYTDLEKEAPWEYQKRPPPAWP
HEGVIIFDNVNFMYSPGGPLVLKHLTALIKSQEKVGIVGRTGAGKSSLISALFRLSEPEGKIWIDKILTTEIGL
HDLRKKMSIIPQEPVLFTGTMRKNLDPPFKEHTDEELWNALQEVQLKETIEDLPGKMDTELAESGSNFSVGQRQL
VCLARAILRKNQILIIDEATANVDPRTDELIQKKIREKFAHCTVLTIAHRLNTIIDSDKIMVLDSGRLKEYDEP
YVLLQNKESLFYKMVQQLGKAEAAALTETAKQVYFKRNYPHIGHTDHMVTNTSNGQPSTLTIFETAL
```

Transmembrane domains:

amino acids 134-154, 233-253, 346-366, 708-728, 767-787, 834-854, 857-877, 948-968, 967-987

N-glycosylation sites.

amino acids 651-654, 690-693, 746-749, 754-757, 792-795, 1176-1179, 1309-1312 cAMP- and cGMP-dependent protein kinase phosphorylation site.

amino acids 1115-1118

Tyrosine kinase phosphorylation sites.

amino acids 37-45, 497-504, 1253-1259

N-myristoylation sites.

amino acids 192-197, 318-323, 343-348, 430-435, 448-453, 487-492, 532-537, 537-542, 624-629, 672-677, 752-575, 766-771, 770-775, 779-784, 980-985, 1078-1083, 1174-1179, 1313-1318

Amidation sites.

amino acids 405-410, 495-500

ATP/GTP-binding site motif A (P-loop).

amino acids 445-452, 1075-1082

ABC transporter.

amino acids 438-609, 1068-1250

ABC transporter transmembrane region.

amino acids 92-365, 711-997

FIGURE 128

MSALRRKFGDDYQVVTTSSSGSGLQPQGPGQDPQQQLVPKKKRQRFVDKNGRCNVQHGNLGSETSRYLSDLFTT
LVDLKWRWNLFIFILTYTVAWLFMASMWWVIAYTRGDLNKAHVGNYTPCVANVYNFPSAFLFFIETEATIGYGY
RYITDKCPEGIILFLFQSILGSIVDAFLIGCMFIKMSQPKKRAETLMFSEHAVISMRDGKLTLMFRVGNLRNSH
MVSAQIRCKLLKSRQTPEGEFLPLDQLELDVGFSTGADQLFLVSPLTICHVIDAKSPFYDLSQRSMQTEQFEIV
VILEGIVETTGMTCQARTSYTEDEVLWGHRFFPVISLEEGFFKVDYSQFHATFEVPTPPYSVKEQEEMLLMSSP
LIAPAITNSKERHNSVECLDGLDDITTKLPSKLQKITGREDFPKKLLRMSSTTSEKAYSLGDLPMKLQRISSVP
GNSEEKLVSKTTKMLSDPMSQSVADLPPKLQKMAGGAARMEGNLPAKLRKMNSDRFT

Transmembrane domains.

amino acids 83-103, 120-140, 158-178

Glycosaminoglycan attachment site.

amino acids 20-23

N-myristoylation sites.

amino acids 58-63, 61-66, 216-221, 301-306, 486-491

Cell attachment sequence.

amino acids 109-114

Inward rectifier potassium channel.

amino acids 47-393

FIGURE 129

```
MPLFKNTSVSSLYSGCRLTLLRPEKDGAATRVDAVCTHRPDPKSPGLDRERLYWKLSQLTHGITELGPYTLDRH
SLYVNGFTHQSSMTTTRTPDTSTMHLATSRTPASLSGPTTASPLLVLFTINFTITNLRYEENMHHPGSRKFNTT
ERVLQGLLRPVFKNTSVGPLYSGCRLTLLRPKKDGAATKVDAICTYRPDPKSPGLDREQLYWELSQLTHSITEL
GPYTLDRDSLYVNGFTQRSSVPTTSIPGTPTVDLGTSGTPVSKPGPSAASPLLVLFTLNFTITNLRYEENMQHP
GSRKFNTTERVLQGLLRSLFKSTSVGPLYSGCRLTLLRPEKDGTATGVDAICTHHPDPKSPRLDREQLYWELSQ
LTHNITELGHYALDNDSLFVNGFTHRSSVSTTSTPGTPTVYLGASKTPASIFGPSAASHLLILFTLNFTITNLR
YEENMWPGSRKFNTTERVLQGLLRPLFKNTSVGPLYSGSRLTLLRPEKDGEATGVDAICTHRPDPTGPGLDREQ
LYLELSQLTHSITELGPYTLDRDSLYVNGFTHRSSVPTTSTGVVSEEPFTLNFTINNLRYMADMGQPGSLKFNI
TDNVMKHLLSPLFQRSSLGARYTGCRVIALRSVKNGAETRVDLLCTYLQPLSGPGLPIKQVFHELSQQTHGITR
LGPYSLDKDSLYLNGYNEPGLDEPPTTPKPATTFLPPLSEATTAMGYHLKTLTLNFTISNLQYSPDMGKGSATF
NSTEGVLQHLLRPLFQKSSMGPFYLGCQLISLRPEKDGAATGVDTTCTYHPDPVGPGLDIQQLYWELSQLTHGV
TQLGFYVLDRDSLFINGYAPQNLSIRGEYQINFHIVNWNLSNPDPTSSEYITLLRDIQDKVTTLYKGSQLHDTF
RFCLVTNLTMDSVLVTVKALFSSNLDPSLVEQVFLDKTLNASFHWLGSTYQLVDIHVTEMESSVYQPTSSSSTQ
HFYPNFTITNLPYSQDKAQPGTTNYQRNKRNIEDALNQLFRNSSIKSYFSDCQVSTFRSVPNRHHTGVDSLCNF
SPLARRVDRVAIYEEFLRMTRNGTQLQNFTLDRSSVLVDGYSPNRNEPLTGNSDLPFWAVIFIGLAGLLGLITC
LICGVLVTTRRRKKEGEYNVQQQCPGYYQSHLDLEDLQ
```

Transmembrane domains.

amino acids 107-127, 418-438, 1093-1113

N-glycosylation sites.

amino acids 6-9, 125-128, 146-149, 162-165, 281-284, 302-305, 374-377, 385-388, 437-440, 457-460, 473-476, 570-573, 591-594, 721-724, 741-744, 836-839, 853-856, 895-898, 928-931, 967-970, 1004-1007, 1058-1061, 1064-1067

Glycosaminoglycan attachment site.

amino acids 644-647

Tyrosine kinase phosphorylation sites.

amino acids 358-365, 1121-1128

N-myristoylation sites.

amino acids 15-20, 171-176, 260-265, 310-315, 327-332, 339-344, 482-487, 583-588, 611-616, 778-783, 782-787, 1106-1111, 1114-1119

SEA domain.

amino acids 112-245, 270-391, 661-684

FIGURE 130

MGNWVVNHWFSVLFLVVWLGLNVFLFVDAFLKYEKADKYYYTRKILGSTLACARASALCLNFNSTLILLPVCRN
LLSFLRGTCSFCSRTLRKQLDHNLTFHKLVAYMICLHTAIHIIAHLFNFDCYSRSRQATDGSLASILSSLSHDE
KKGGSWLNPIQSRNTTVEYVTFTSVAGLTGVIMTIALILMVTSATEFIRRSYFEVFWYTHHLFIFYILGLGIHG
IGGIVRGQTEESMNESHPRKCAESFEMWDDRDSHCRRPKFEGHPPESWKWILAPVILYICERILRFYRSQQKVV
ITKVVMHPSKVLELQMNKRGFSMEVGQYIFVNCPSISLLEWHPFTLTSAPEEDFFSIHIRAAGDWTENLIRAFE
QQYSPIPRIEVDGPFGTASEDVFQYEVAVLVGAGIGVTPFASILKSIWYKFQCADHNLKTKKIYFYWICRETGA
FSWFNNLLTSLEQEMEELGKVGFLNYRLFLTGWDSNIVGHAALNFDKATDIVTGLKQKTSFGRPMWDNEFSTIA
TSHPKSVVGVFLCGPRTLAKSLRKCCHRYSSLDPRKVQFYFNKENF

Signal sequence.

amino acids 1-29

Transmembrane domain.

amino acids 44-64, 60-80, 99-119, 168-188, 204-224

N-glycosylation sites.

amino acids 63-66, 97-100, 162-165, 236-239

Tyrosine kinase phosphorylation sites.

amino acids 198-206, 367-373

N-myristoylation sites.

amino acids 47-52, 135-140, 178-183, 225-230, 402-407, 527-532

Ferric reductase like.

amino acids 46-563

FIGURE 131

MGNWVVNHWFSVLFLVVWLGLNVFLFVDAFLKYEKADKYYYTRKILGSTLACARASALCLNFNSTLILLPVCRN
LLSFLRGTCSFCSRTLRKQLDHNLTFHKLVAYMICLHTAIHIIAHLFNFDCYSRSRQATDGSLASILSSLSHDE
KKGGSWLNPIQSRNTTVEYVTFTSIAGLTGVIMTIALILMVTSATEFIRRSYFEVFWYTHHLFIFYILGLGIHG
IGGIVRGQTEESMNESHPRKCAESFEMWDDRDSHCRRPKFEGHPPESWKWILAPVILYICERILRFYRSQQKVV
ITKVVMHPSKVLELQMNKRGFSMEVGQYIFVNCPSISLLEWHPFTLTSAPEEDFFSIHIRAAGDWTENLIRAFE
QQYSPIPRIEVDGPFGTASEDVFQYEVAVLVGAGIGVTPFASILKSIWYKFQCADHNLKTKKIYFYWICRETGA
FSWFNNLLTSLEQEMEELGKVGFLNYRLFLTGWDSNIVGHAALNFDKATDIVTGLKQKTSFGRPMWDNEFSTIA
TSHPKSVVGVFLCGPRTLAKSLRKCCHRYSSLDPRKVQFYFNKENF

Transmembrane domains.
amino acids 6-26, 44-64, 60-80, 99-119, 168-188, 204-224

N-glycosylation sites.
amino acids 63-66, 97-100, 162-165, 236-239

Tyrosine kinase phosphorylation sites.
amino acids 198-206, 367-373

N-myristoylation sites.
amino acids 47-52, 135-140, 178-183, 225-230, 402-407, 527-532

Ferric reductase like transmembrane.
amino acids 46-563

FIGURE 132

MGNWVVNHWFSVLFLVVWLGLNVFLFVDAFLKYEKADKYYYTRKILGSWKWILAPVILYICERILRFYRSQQKV
VITKVVMHPSKVLELQMNKRGFSMEVGQYIFVNCPSISLLEWHPFTLTSAPEEDFFSIHIRAAGDWTENLIRAF
EQQYSPIPRIEVDGPFGTASEDVFQYEVAVLVGAGIGVTPFASILKSIWYKFQCADHNLKTKKVGHAALNFDKA
TDIVTGLKQKTSFGRPMWDNEFSTIATSHPKSVVGVFLCGPRTLAKSLRKCCHRYSSLDPRKVQFYFNKENFO

Transmembrane domains.
amino acids 6-26, 44-64

Tyrosine kinase phosphorylation site.
amino acids 146-152

N-myristoylation sites.
amino acids 181-186, 257-262

Ferric reductase like transmembrane.
amino acids 1-293

FIGURE 133

MGNWVVNHWFSVLFLVVWLGLNVFLFVDAFLKYEKADKYYYTRKILGSTLACARASALCLNFNSTLILLPVCRN
LLSFLRGTCSFCSRTLRKQLDHNLTFHKLVAYMICLHTAIHIIAHLFNFDCYSRSRQATDGSLASILSSLSHDE
KKGGSWLNPIQSRNTTVEYVTFTSIAGLTGVIMTIALILMVTSATEFIRRSYFEVFWYTHHLFIFYILGLGIHG
IGGIVRGQTEESMNESHPRKCAESFEMWDDRDSHCRRPKFEGHPPESWKWILAPVILYICERILRFYRSQQKVV
ITKVVMHPSKVLELQMNKRGFSMEVGQYIFVNCPSISLLEWHPFTLTSAPEEDFFSIHIRAAGDWTENLIRAFE
QQYSPIPRIEVDGPFGTASEDVFQYEVAVLVGAGIGVTPFASILKSIWYKFQCADHNLKTKKVGHAALNFDKAT
DIVTGLKQKTSFGRPMWDNEFSTIATSHPKSVVGVFLCGPRTLAKSLRKCCHRYSSLDPRKVQFYFNKENF

Transmembrane domains.
amino acids 6-26, 44-64, 60-80, 99-119, 168-188, 204-224

N-glycosylation sites.
amino acids 63-66, 97-100, 162-165, 236-239

Tyrosine kinase phosphorylation sites.
amino acids 198-206, 367-373

N-myristoylation sites.
amino acids 47-52, 135-140, 178-183, 225-230, 402-407, 478-483

Ferric reductase like transmembrane.
amino acids 46-514

FIGURE 134

MTSGSVFFYILIFGKYFSHGGGQDVKCSLGYFPCGNITKCLPQLLHCNGVDDCGNQADEDNCGDNNGWSMQFDK
YFASYYKMTSQYPFEAETPECLVGSVPVQCLCQGLELDCDETNLRAVPSVSSNVTAMSLQWNLIRKLPPDCFKN
YHDLQKLYLQNNKITSISIYAFRGLNSLTKLYLSHNRITFLKPGVFEDLHRLEWLIIEDNHLSRISPPTFYGLN
SLILLVLMNNVLTRLPDKPLCQHMPRLHWLDLEGNHIHNLRNLTFISCSNLTVLVMRKNKINHLNENTFAPLQK
LDELDLGSNKIENLPPLIFKDLKELSQLNLSYNPIQKIQANQFDYLVKLKSLSLEGIEISNIQQRMFRPLMNLS
HIYFKKFQYCGYAPHVRSCKPNTDGISSLENLLASIIQRVFVWVVSAVTCFGNIFVICMRPYIRSENKLYAMSI
ISLCCADCLMGIYLFVIGGFDLKFRGEYNKHAQLWMESTHCQLVGSLAILSTEVSVLLLTFLTLEKYICIVYPF
RCVRPGKCRTITVLILIWITGFIVAFIPLSNKEFFKNYYGTNGVCFPLHSEDTESIGAQIYSVAIFLGINLAAF
IIIVFSYGSMFYSVHQSAITATEIRNQVKKEMILAKRFFFIVFTDALCWIPIFVVKFLSLLQVEIPGTITSWVV
IFILPINSALNPILYTLTTRPFKEMIHRFWYNYRQRKSMDSKGQKTYAPSFIWVEMWPLQEMPPELMKPDLFTY
PCEMSLISQSTRLNSYS

Transmembrane domains.

amino acids 212-232, 404-424, 443-463, 489-509, 526-546, 577-597, 629-649, 665-685

N-glycosylation sites.

amino acids 36-39, 127-130, 264-267, 272-275, 325-328, 368-371

N-myristoylation sites.

amino acids 49-54, 352-357, 586-591, 659-664

Leucine zipper pattern.

amino acids 487-508

LDL-receptor class A.

amino acids 40-59

G-protein coupled receptor.

amino acids 159-189, 413-432, 422-452, 436-466, 478-518, 528-547, 625-644, 673-689

Leucine rich repeats.

amino acids 127-150, 151-174, 175-198, 199-222, 223-246, 248-271, 272-295, 296-319, 320-343, 344-367

7 transmembrane receptor (rhodopsin family proteins).

amino acids 485-681

Low-density lipoprotein receptor domain.

amino acids 25-64

FIGURE 135

```
MTSGSVFFYILIFGKYFSHGGGQDVKCSLGYFPCGNITKCLPQLLHCNGVDDCGNQADEDNCGDNNGWSLQFDK
YFASYYKMTSQYPFEAETPECLVGSVPVQCLCQGLELDCDETNLRAVPSVSSNVTAMSLQWNLIRKLPPDCFKN
YHDLQKLYLQNNKITSISIYAFRGLNSLTKLYLSHNRITFLKPGVFEDLHRLEWLIIEDNHLSRISPPTFYGLN
SLILLVLMNNVLTRLPDKPLCQHMPRLHWLDLEGNHIHNLRNLTFISCSNLTVLVMRKNKINHLNENTFAPLQK
LDELDLGSNKIENLPPLIFKDLKELSQLNLSYNPIQKIQANQFDYLVKLKSLSLEGIEISNIQQRMFRPLMNLS
HIYFKKFQYCGYAPHVRSCKPNTDGISSLENLLASIIQRVFVWVVSAVTCFGNIFVICMRPYIRSENKLYAMSI
ISLCCADCLMGIYLFVIGGFDLKFRGEYNKHAQLWMESTHCQLVGSLAILSTEVSVLLLTFLTLEKYICIVYPF
RCVRPGKCRTITVLILIWITGFIVAFIPLSNKEFFKNYYGTNGVCFPLHSEDTESIGAQIYSVAIFLGINLAAF
IIIVFSYGSMFYSVHQSAITATEIRNQVKKEMILAKRFFFIVFTDALCWIPIFVVKFLSLLQVEIPGTITSWVV
IFILPINSALNPILYTLTTRPFKEMIHRFWYNYRQRKSMDSKGQKTYAPSFIWVEMWPLQEMPPELMKPDLFTY
PCEMSLISQSTRLNSYS
```

Transmembrane domains.

amino acids 212-232, 404-424, 443-463, 489-509, 526-546, 577-597, 629-649, 665-685

N-glycosylation sites.

amino acids 36-39, 127-130, 264-267, 272-275, 325-328, 368-371

N-myristoylation sites.

amino acids 49-54, 352-357, 586-591, 659-664

Leucine zipper pattern.

amino acids 487-508

Leucine rich repeats.

amino acids 127-150, 151-174, 175-198, 199-222, 223-246, 248-271, 272-295, 296-319, 320-343, 344-367

7 transmembrane receptor (rhodopsin family).

amino acids 59-259

Low-density lipoprotein receptor domain.

amino acids 25-64

FIGURE 136

```
MGRLASRPLLLALLSLALCRGRVVRVPTATLVRVVGTELVIPCNVSDYDGPSEQNFDWSFSSLGSSFVELASTW
EVGFPAQLYQERLQRGEILLRRTANDAVELHIKNVQPSDQGHYKCSTPSTDATVQGNYEDTVQVKVLADSLHVG
PSARPPPSLSLREGEPFELRCTAASASPLHTHLALLWEVHRGPARRSVLALTHEGRFHPGLGYEQRYHSGDVRL
DTVGSDAYRLSVSRALSADQGSYRCIVSEWIAEQGNWQEIQEKAVEVATVVIQPTVLRAAVPKNVSVAEGKELD
LTCNITTDRADDVRPEVTWSFSRMPDSTLPGSRVLARLDRDSLVHSSPHVALSHVDARSYHLLVRDVSKENSGY
YYCHVSLWAPGHNRSWHKVAEAVSSPAGVGVTWLEPDYQVYLNASKVPGFADDPTELACRVVDTKSGEANVRFT
VSWYYRMNRRSDNVVTSELLAVMDGDWTLKYGERSKQRAQDGDFIFSKEHTDTFNFRIQRTTEEDRGNYYCVVS
AWTKQRNNSWVKSKDVFSKPVNIFWALEDSVLVVKARQPKPFFAAGNTFEMTCKVSSKNIKSPRYSVLIMAEKP
VGDLSSPNETKYIISLDQDSVVKLENWTDASRVDGVVLEKVQEDEFRYRMYQTQVSDAGLYRCMVTAWSPVRGS
LWREAATSLSNPIEIDFQTSGPIFNASVHSDTPSVIRGDLIKLFCIITVEGAALDPDDMAFDVSWFAVHSFGLD
KAPVLLSSLDRKGIVTTSRRDWKSDLSLERVSVLEFLLQVHGSEDQDFGNYYCSVTPWVKSPTGSWQKEAEIHS
KPVFITVKMDVLNAFKYPLLIGIGLSTVIGLLSCLIGYCSSHWCCKKEVQETRRERRRLMSMEMD
```

Signal sequence.
amino acids 1-21

Transmembrane domain.
amino acids 833-853

N-glycosylation sites.
amino acids 44-47, 286-289, 300-303, 383-386, 413-416, 525-528, 600-603, 618-621, 691-694

Tyrosine kinase phosphorylation site.
amino acids 632-640

N-myristoylation sites.
amino acids 243-248, 398-403, 511-516, 651-656, 753-758, 789-794, 836-841, 844-849

Cell attachment sequence.
amino acids 703-705

Immunoglobulin domain.
amino acids 36-121, 162-249, 292-375, 422-517, 564-657, 704-795

FIGURE 137

MSRSRHLGKIRKRLEDVKSQWVRPARADFSDNESARLATDALLDGGSEAYWRVLSQEGEVDFLSSVEAQYIQAQ
AREPPCPPDTLGGAEAGPKGLDSSSLQSGTYFPVASEGSEPALLHSWASAEKPYLKEKSSATVYFQTVKHNNIR
DLVRRCITRTSQVLVILMDVFTDVEIFCDILEAANKRGVFVCVLLDQGGVKLFQEMCDKVQISDSHLKNISIRS
VEGEIYCAKSGRKFAGQIREKFIISDWRFVLSGSYSFTWLCGHVHRNILSKFTGQAVELFDEEFRHLYASSKPV
MGLKSPRLVAPVPPGAAPANGRLSSSSGSASDRTSSNPFSGRSAGSHPGTRSVSASSGPCSPAAPHPPPPPRFQ
PHQGPWGAPSPQAHLSPRPHDGPPAAVYSNLGAYRPTRLQLEQLGLVPRLTPTWRPFLQASPHF

Transmembrane domain.
amino acids 154-175

N-glycosylation sites.
amino acids 32-35, 217-220

Tyrosine kinase phosphorylation site.
amino acids 221-228

N-myristoylation sites.
amino acids 45-50, 86-91, 94-99, 112-117, 186-191, 311-316, 341-346

Amidation site.
amino acids 232-235

FIGURE 138

```
MALPQPPPPAGARDPVTPEHWASGPPSQAQPLLRQEAKEEEEGEETGVQGAWGTGTAEQRRRGWGEAAESAAAE
EGQAEVGGAAAAGSGSPAGGAGGGLGSWRPLLAWLQRRQPQCCPCAAPLSRSAAHCCHGGTKMAALAYNLGKRE
INHYFSVRSAKVLALVAVLLLAACHLASRRYRGNDSCEYLLSSGRFLGEKVWQPHSCMMHKYKISEAKNCLVDK
HIAFIGDSRIRQLFYSFVKIINPQFKEEGNKHENIPFEDKTASVKVDFLWHPEVNGSMKQCIKVWTEDSIAKPH
VIVAGAATWSIKIHNGSSEALSQYKMNITSIAPLLEKLAKTSDVYWVLQDPVYEDLLSENRKMITNEKIDAYNE
AAVSILNSSTRNSKSNVKMFSVSKLIAQETIMESLDGLHLPESSRETTAMILMNVYCNKILKPVDGSCCQPRPP
VTLIQKLAACFFTLSIIGYLIFYIIHRNAHRKNKPCTDLESGEEKKNIINTPVSSLEILLQSFCKLGLIMAYFY
MCDRANLFMKENKFYTHSSFFIPIIYILVLGVFYNENTKETKVLNREQTDEWKGWMQLVILIYHISGASTFLPV
YMHIRVLVAAYLFQTGYGHFSYFWIKGDFGIYRVCQVLFRLNFLVVVLCIVMDRPYQFYYFVPLVTVWFMVIYV
TLALWPQIIQKKANGNCFWHFGLLLKLGFLLLFICFLAYSQGAFEKIFSLWPLSKCFELKGNVYEWWFRWRLDR
YVVFHGMLFAFIYLALQKRQILSEGKGEPLFSNKISNFLLFISVVSFLTYSIWASSCKNKAECNELHPSVSVVQ
ILAFILIRNIPGYARSVYSSFFAWFGKISLELFICQYHIWLAADTRGILVLIPGNPMLNIIVSTFIFVCVAHEI
SQITNDLAQIIIPKDNSSLLKRLACIAAFFCGLLILSSIQDKSKH
```

Transmembrane domains.
amino acids 153-173, 447-467, 495-515, 532-552, 577-597, 624-644, 651-671, 677-697, 693-713, 733-753, 771-791, 808-828, 866-886, 904-924

N-glycosylation sites.
amino acids 182-185, 277-280, 311-314, 323-326, 377-380, 904-907

Tyrosine kinase phosphorylation site.
amino acids 180-187

N-myristoylation sites.
amino acids 47-52, 50-55, 53-58, 81-86, 82-87, 89-94, 93-98, 94-99, 96-101, 97-102, 134-139, 181-186, 312-317, 511-516, 549-554, 746-751

Amidation site.
amino acids 144-147

FIGURE 139

MYHCHSGSKPTEKGANEYAYAKWKLCSASAICFIFMIAEVVGGHIAGSLAVVTDAAHLLIDLTSFLLSLFSLWL
SSKPPSKRLTFGWHRAEILGALLSILCIWVVTGVLVYLACERLLYPDYQIQATVMIIVSSCAVAANIVLTVVLH
QRCLGHNHKEVQANASVRAAFVHALGDLFQSISVLISALIIYFKPEYKIADPICTFIFSILVLASTITILKDFS
ILLMEGVPKSLNYSGVKELILAVDGVLSVHSLHIWSLTMNQVILSAHVATAASRDSQVVRREIAKALSKSFTMH
SLTIQMESPVDQDPDCLFCEDPCD

Transmembrane domains.
amino acids 53-73, 91-111, 127-147, 166-186, 202-222

N-glycosylation sites.
amino acids 162-165, 234-237 cAMP- and cGMP-dependent protein kinase phosphorylation site.
amino acids 81-84

Tyrosine kinase phosphorylation site.
amino acids 13-20

N-myristoylation sites.
amino acids 7-12, 42-47, 94-99, 228-233

Cation efflux family.
amino acids 78-306

FIGURE 140

MVLSVPVIALGATLGTATSILALCGVTCLCRHMHPKKGLLPRDQDPDLEKAKPSLLGSAQQFNVKKSTEPVQPR
ALLKFPDIYGPRPAVTAPEVINYADYSLRSTEEPTAPASPQPPNDSRLKRQVTEELFILPQNGVVEDVCVMETW
NPEKAASWNQAPKLHYCLDYDCQKAELFVTRLEAVTSNHDGGCDCYVQGSVANRTGSVEAQTALKKRQLHTTWE
EGLVLPLAEEELPTATLTLTLRTCDRFSRHSVAGELRLGLDGTSVPLGAAQWGELKTSAKEPSAGAGEVLLSIS
YLPAANRLLVVLIKAKNLHSNQSKELLGKDVSVKVTLKHQARKLKKKQTKRAKHKINPVWNEMIMFELPDDLLQ
ASSVELEVLGQDDSGQSCALGHCSLGLHTSGSERSHWEEMLKNPRRQIAMWHQLHL

Signal sequence.

amino acids 1-24

Transmembrane domain.

amino acids 4-24

N-glycosylation sites.

amino acids 118-121, 201-204, 317-320 cAMP- and cGMP-dependent protein kinase phosphorylation sites.

amino acids 65-68, 342-345

N-myristoylation sites.

amino acids 11-16, 15-20, 189-194, 197-202, 204-209, 261-266, 380-385, 385-390, 396-401, 401-406

C2 domain.

amino acids 304-394

FIGURE 141

```
MQKIMHISVLLSPVLWGLIFGVSSNSIQIGGLFPRGADQEYSAFRVGMVQFSTSEFRLTPHIDNLEVANSFAVT
NAFCSQFSRGVYAIFGFYDKKSVNTITSFCGTLHVSFITPSFPTDGTHPFVIQMRPDLKGALLSLIEYYQWDKF
AYLYDSDRGLSTLQAVLDSAAEKKWQVTAINVGNINNDKKDEMYRSLFQDLELKKERRVILDCERDKVNDIVDQ
VITIGKHVKGYHYIIANLEFTDGDLLKIQFGGANVSGFQIVDYDDSLVSKFIERWSTLEEKEYPGAHTTTIKYT
SALTYDAVQVMTEAFRNLRKQRIEISRRGNAGDCLANPAVPWGQGVEIERALKQVQVEGLSGNIKFDQNGKRIN
YTINIMELKTNGPRKIGYWSEVDKMVVTLTELPSGNDTSGLENKTVVVTTILESPYVMMKKNHEMLEGNERYEG
YCVDLAAEIAKHCGFKYKLTIVGDGKYGARDADTKIWNGMVGELVYGKADIAIAPLTITLVREEVIDFSKPFMS
LGISIMIKKPQKSKPGVFSFLDPLAYEIWMCIVFAYIGVSVVLFLVSRFSPYEWHTEEFEDGRETQSSESTNEF
GIFNSLWFSLGAFMRQGCDISPRSLSGRIVGGVWWFFTLIIISSYTANLAAFLTVERMVSPIESAEDLSKQTEI
AYGTLDSGSTKEFFRRSKIAVFDKMWTYMRSAEPSVFVRTTAEGVARVRKSKGKYAYLLESTMNEYIEQRKPCD
TMKVGGNLDSKGYGIATPKGSSLGTPVNLAVLKLSEQGVLDKLKNKWWYDKGECGAKDSGSKEKTSALSLSNVA
GVFYILVGGLGLAMLVALIEFCYKSRAEAKRMKVAKNAQNINPSSSQNSQNFATYKEGYNVYGIESVKI
```

Signal sequence.
amino acids 1-21

Transmembrane domains.
amino acids 4-24, 543-563, 624-644, 811-831

N-glycosylation sites.
amino acids 256-259, 370-373, 406-409, 413-416

Tyrosine kinase phosphorylation sites.
amino acids 35-41, 662-667

N-myristoylation sites.
amino acids 17-22, 21-26, 134-140, 181-186, 254-259, 287-292, 355-360, 405-410, 472-477, 593-598, 669-674, 746-751, 760-765, 764-769, 795-800, 823-828

Amidation site.
amino acids 365-368

Ligand-gated ion channel.
amino acids 543-834

Receptor family ligand binding region.
amino acids 56-398

FIGURE 142

MATTVPDGCRNGLKSKYYRLCDKAEAWGIVLETVATAGVVTSVAFMLTLPILVCKVQDSNRRKMLPTQFLFLLG
VLGIFGLTFAFIIGLDGSTGPTRFFLFGILFSICFSCLLAHAVSLTKLVRGRKPLSLLVILGLAVGFSLVQDVI
AIEYIVLTMNRTNVNVFSELSAPRRNEDFVLLLTYVLFLMALTFLMSSFTFCGSFTGWKRHGAHIYLTMLLSIA
IWVAWITLLMLPDFDRRWDDTILSSALAANGWVFLLAYVSPEFWLLTKQRNPMDYPVEDAFCKPQLVKKSYGVE
NRAYSQEEITQGFEETGDTLYAPYSTHFQLQNQPPQKEFSIPRAHAWPSPYKDYEVKKEGS

Transmembrane domains.

amino acids 30-50, 66-86, 98-118, 121-141, 137-157, 174-194, 212-232, 244-264

N-glycosylation site.

amino acids 158-161

N-myristoylation sites.

amino acids 8-13, 38-43, 80-85, 88-93, 102-107, 136-141, 201-206

Amidation site.

amino acids 124-127

7 transmembrane receptor.

amino acids 27-273

FIGURE 143

MLPAQEAAKLYHTNYVRNSRAIGVLWAIFTICFAIVNVVCFIQPYWIGDGVDTPQAGYFGLFHYCIGNGFSREL
TCRGSFTDFSTLPSGAFKAASFFIGLSMMLIIACIICFTLFFFCNTATVYKICAWMQLTSAACLVLGCMIFPDG
WDSDEVKRMCGEKTDKYTLGACSVRWAYILAIIGILDALILSFLAFVLGNRQDSLMAEELKAENKVLLSQYSLE

Transmembrane domains.
amino acids 21-41, 93-113, 127-147, 173-193

N-myristoylation sites.
amino acids 23-28, 67-72, 89-94, 182-187

FIGURE 144

MPGAAAAAAAAAAAMLPAQEAAKLYHTNYVRNSRAIGVLWAIFTICFAIVNVVCFIQPYWIGDGVDTPQAGYFG
LFHYCIGNGFSRELTCRGSFTDFSTLPSGAFKAASFFIGLSMMLIIACIICFTLFFFCNTATVYKICAWMQLTS
AACLVLGCMIFPDGWDSDEVKRMCGEKTDKYTLGACSVRWAYILAIIGILDALILSFLAFVLGNRQDSLMAEEL
KAENKVLLSQYSLE

Transmembrane domains.
amino acids 1-15, 34-54, 107-127, 141-161, 187-207

N-myristoylation sites.
amino acids 3-8, 37-42, 81-86, 103-108, 196-201

FIGURE 145

MPGAAAAAAAAAAAMLPAQEAAKLYHTNYVRNSRAIGVLWAIFTICFAIVNVVCFIQPYWIGDGVDTPQAGYFG
LFHYCIGNGFSRELTCRGSFTDFSTLPSGAFKAASFFIGLSMMLIIACIICFTLFFFCNTATVYKICAWMQLTS
AACLVLGCMIFPDGWDSDEVKRMCGEKTDKYTLGACSVRWAYILAIIGILDALILSFLAFVLGNRQDSLMAEEL
KAENKVLLSQYSLE

Transmembrane domains.

amino acids 1-15, 34-54, 107-127, 141-161, 187-207

N-myristoylation sites.

amino acids 3-8, 37-42, 81-86, 103-108, 196-201

FIGURE 146

RPLRLPCRGPRAAGTVSSESLGHPAPGQVTNRSPQFPMELFQSSPRPPLQPVCVCPGLELCDPPHRLAFSMGAG
LFSVVGTLLLPGLAALVQDWRLLQGLGALMSGLLLLFWGFPALFPESPCWLLATGQVARARKILWRFAEASGVG
PGDSSLEENSLATELTMLSARSPQPRYHSPLGLLRTRVTWRNGLILGFSSLVGGGIRASFRRSLAPQVPTFYLP
YFLEAGLEAAALVFLLLTADCCGRRPVLLLGTMVTGLASLLLLAGAQYLPGWTVLFLSVLGLLASRAVSALSSL
FAAEVFPTVIRGAGLGLVLGAGFLGQAAGPLDTLHGRQGFFLQQVVFASLAVLALLCVLLLPESRSRGLPQSLQ
DADRLRRSPLLRGRPRQDHLPLLPPSNSYWAGHTPEQH

Transmembrane domains.
amino acids 67-87, 102-122, 220-240, 249-269, 265-285, 301-321, 338-358

Glycosaminoglycan attachment site.
amino acids 145-148

N-myristoylation sites.
amino acids 14-19, 27-32, 57-62, 101-106, 146-151, 180-185, 191-196, 202-207, 203-208, 228-233, 253-258, 283-288, 308-313, 312-317, 364-369

Amidation site.
amino acids 244-247

Leucine zipper pattern.
amino acids 96-117

Sugar transport proteins.
amino acids 117-126, 241-253, 276-321

FIGURE 147

```
MPFEQCHLSWKNVRRLYNAVSKELVGEFLQFVQLDKEASDPFSLNELLDELSRKQKEELWQRLKNLLTDVLLES
PVDGWQVVEAQGEDNMETEHGSKMRKSIEIIYAITSVILASVSVINESENYEALLECVIILNGILYALPESERK
LQSSIQDLCVTWWEKGLPAKEDTGKTAFVMLLRRSLETKTGADVCRLWRIHQALYCFDYDLEESGEIKDMLLEC
FININYIKKEEGRRFLSCLFNWNINFIKMIHGTIKNQLQGLQKSLMVYIAEIYFRAWKKASGKILEAIENDCIQ
DFMFHGIHLPRRSPVHSKVREVLSYFHHQKKVRQGVEEMLYRLYKPILWRGLKARNSEVRSNAALLFVEAFPIR
DPNLHAIEMDSXIQKQFEELYSLLEDPYPMVRSTGILGVCKITSKYWEMMPPTILIDLLKKVTGELAFDTSSAD
VRCSVFKCLPMILDNKLSHPLLEQLLPALRYSLHDNSEKVRVAFVDMLLKIKAVRAAKFWKICPMEHILVRLET
DSRPVSRRLVSLIFNSFLPVNQPEEVWCERCVTLVQMNHAAARRFYQYAHEHTACTNIAKLIHVIRHCLNACIQ
RAVREPPEDEEEEDGREKENVTVLDKTLSVNDVACMAGLLEIIVILWKSIDRSMENNKEAKLYTINKFASVLPE
YLKVFKDDRCKIPLFMLMSFMPASAVPPFSCGVISTLRSREEGAVDKSYCTLLDCLCSWGQVGHILELVDNWLP
TEHAQAKSNTASKGRVQIHDTRPVKPELALVYIEYLLTHPKNRECLLSAPRKKLNHLLKALETSKADLESLLQT
PGGKPRGFSEAAAPRAFGLHCRLSIHLQHKFCSEGKVYLSMLEDTGFWLESKILSFIQDQEEDYLKLHRVIYQQ
IIQTYLTVCKDVVMVGLGDHQFQMQLLQRSLGIMQTVKGFFYVSLLLDILKEITGSSLIQKTDSDEEVAMLLDT
VQKVFQKMLECIARSFRKQPEEGLRLLYSVQRPLHEFITAVQSRHTDTPVHRGVLSTLIAGPVVEISHQLRKVS
DVEELTPPEHLSDLPPFSRCLIGIIIKSSNVVRSFLDELKACVASNDIEGIVCLTAAVHIILVINAGKHKSSKV
REVAATVHRKLKTFMEITLEEDSIERFLYESSSRTLGELLNS
```

Transmembrane domain.
amino acids 1081-1101
N-glycosylation sites.
amino acids 120-123, 612-615
cAMP- and cGMP-dependent protein kinase phosphorylation sites.
amino acids 280-283, 430-433, 1033-1036
Tyrosine kinase phosphorylation sites.
amino acids 99-106, 314-321, 329-337, 385-391, 844-852
N-myristoylation sites.
amino acids 137-142, 189-194, 254-259, 262-267, 698-703, 920-925, 1015-1020
Amidation site.
amino acids 233-236
ATP/GTP-binding site motif A (P-loop).
amino acids 167-174
Leucine zipper pattern.
amino acids 128-149, 135-156, 787-808
Mitochondrial energy transfer proteins signature.
amino acids 982-990

FIGURE 148

```
MEKRETFVQAVSKELVGEFLQFVQLDKEASDPFSLNELLDELSRKQKEELWQRLKNLLTDVLLESPVDGWQVVE
AQGEDNMETEHGSKMRKSIEIIYAITSVILASVSVINESENYEALLECVIILNGILYALPESERKLQSSIQDLC
VTWWEKGLPAKEDTGKTAFVMLLRRSLETKTGADVCRLWRIHQALYCFDYDLEESGEIKDMLLECFININYIKK
EEGRRFLSCLFNWNINFIKMIHGTIKNQLQGLQKSLMVYIAEIYFRAWKKASGKILEAIENDCIQDFMFHGIHL
PRRSPVHSKVREVLSYFHHQKKVRQGVEEMLYRLYKPILWRGLKARNSEVRSNAALLFVEAFPIRDPNLHAIEM
DSEIQKQFEELYSLLEDPYPMVRSTGILGVCKITSKYWEMMPPTILIDLLKKVTGELAFDTSSADVRCSVFKCL
PMILDNKLSHPLLEQLLPALRYSLHDNSEKVRVAFVDMLLKIKAVRAAKFWKICPMEHILVRLETDSRPVSRRL
VSLIFNSFLPVNQPEEVWCERCVTLVQMNHAAARRFYQYAHEHTACTNIAKLIHVIRHCLNACIQRAVREPPED
EEEEDGREKENVTVLDKTLSVNDVACMAGLLEIIVILWKSIDRSMENNKEAKLYTINKFASVLPEYLKVFKDDR
CKIPLFMLMSFMPASAVPPFSCGVISTLRSREEGAVDKSYCTLLDCLCSWGQVGHILELVDNWLPTEHAQAKSN
TASKGRVQIHDTRPVKPELALVYIEYLLTHPKNRECLLSAPRKKLNHLLKALETSKADLESLLQTPGGKPRGFS
EAAAPRAFGLHCRLSIHLQHKFCSEGKVYLSMLEDTGFWLESKILSFIQDQEEDYLKLHRVIYQQIIQTYLTVC
KDVVMVGLGDHQFQMQLLQRSLGIMQTVKGFFYVSLLLDILKEITGSSLIQKTDSDEEVAMLLDTVQKVFQKML
ECIARSFRKQPEEGLRLLYSVQRPLHEFITAVQSRHTDTPVHRGVLSTLIAGPVVEISHQLRKVSDVEELTPPE
HLSDLPPFSRCLIGIIIKSSNVVRSFLDELKACVASNDIEGIVCLTAAVHIILVINAGKHKSSKVREVAATVHR
KLKTFMEITLEEDSIERFLYESSSRTLGELLNS
```

Transmembrane domain.

amino acids 1072-1092

N-glycosylation sites.

amino acids 111-114, 603-606 cAMP- and cGMP-dependent protein kinase phosphorylation sites.

amino acids 3-6, 271-274, 421-424, 1024-1027

Tyrosine kinase phosphorylation site.

amino acids 91-97, 305-312, 320-328, 376-382, 835-843

N-myristoylation sites.

amino acids 128-133, 180-185, 245-250, 253-258, 689-694, 911-916, 1006-1011

Amidation site.

amino acids 224-227

ATP/GTP-binding site motif A (P-loop).

amino acids 158-165

Leucine zipper pattern.

amino acids 119-140, 126-147, 778-799

Mitochondrial energy transfer proteins signature.

amino acids 973-981

FIGURE 149

MNSTLFSQVENHSVHSNFSEKNAQLLAFENDDCHLPLAMIFTLALAYGAVIILGVSGNLALIIIILKQKEMRNV
TNILIVNLSFSDLLVAIMCLPFTFVYTLMDHWVFGEAMCKLNPFVQCVSITVSIFSLVLIAVERHQLIINPRGW
RPNNRHAYVGIAVIWVLAVASSLPFLIYQVMTDEPFQNVTLDAYKDKYVCFDQFPSDSHRLSYTTLLLVLQYFG
PLCFIFICYFKIYIRLKRRNNMMDKMRDNKYRSSETKRINIMLLSIVVAFAVCWLPLTIFNTVFDWNHQIIATC
NHNLLFLLCHLTAMISTCVNPIFYGFLNKNFQRDLQFFFNFCDFRSRDDDYETIAMSTMHTDVSKTSLKQASPV
AFKKINNNDDNEKI

Transmembrane domains.

amino acids 38-58, 78-98, 117-137, 155-175, 208-228, 260-280, 296-316

N-glycosylation sites.

amino acids 2-5, 11-14, 17-20, 73-76, 81-84, 186-189

Tyrosine kinase phosphorylation sites.

amino acids 247-253, 341-347

N-myristoylation site.

amino acids 54-59

7 transmembrane receptor (rhodopsin family).

amino acids 57-320

FIGURE 150

MVRCDRGLQMLLTTAGAFAAFSLMAIAIGTDYWLYSSAHICNGTNLTMDDGPPPRRARGDLTHSGLWRVCCIEG
IYKGHCFRINHFPEDNDYDHDSSEYLLRIVRASSVFPILSTILLLLGGLCIGAGRIYSRKNNIVLSAGILFVAA
GLSNIIGIIVYISSNTGDPSDKRDEDKKNHYNYGWSFYFGALSFIVAETVGVLAVNIYIEKNKELRFKTKREFL
KASSSSPYARMPSYRYRRRRSRSSSRSTEASPSRDVSPMGLKITGAIPMGELSMYTLSREPLKVTTAASYSPDQ
EASFLQVHDFFQQDLKEGFHVSMLNRRTTPV

Signal sequence.
amino acids 1-19

Transmembrane domains.
amino acids 103-123, 140-160, 182-202

N-glycosylation sites.
amino acids 42-45, 45-48 cAMP- and cGMP-dependent protein kinase phosphorylation sites.
amino acids 240-243, 322-325

N-myristoylation sites.
amino acids 16-21, 43-48, 74-79, 122-127, 262-267

Cell attachment sequence.
amino acids 58-60

PMP-22/EMP/MP20/Claudin family.
amino acids 6-202

FIGURE 151

MARGPGLAPPPLRLPLLLLVLAAVTGHTAAQDNCTCPTNKMTVCSPDGPGGRCQCRALGSGMAVDCSTLTSKCL
LLKARMSAPKNARTLVRPSEHALVDNDGLYDPDCDPEGRFKARQCNQTSVCWCVNSVGVRRTDKGDLSLRCDEL
VRTHHILIDLRHRPTAGAFNHSDLDAELRRLFRERYRLHPKFVAAVHYEQPTIQIELRQNTSQKAAGEVDIGDA
AYYFERDIKGESLFQGRGGLDLRVRGEPLQVERTLIYYLDEIPPKFSMKRLTAGLIAVIVVVVVALVAGMAVLV
ITNRRKSGKYKKVEIKELGELRKEPSL

Signal sequence.

amino acids 1-26

Transmembrane domain.

amino acids 274-294

N-glycosylation sites.

amino acids 33-36, 120-123, 168-171, 208-211 cAMP- and cGMP-dependent protein kinase phosphorylation sites.

amino acids 271-274, 300-303

N-myristoylation sites.

amino acids 59-64, 132-137

Thyroglobulin type-1 repeat.

amino acids 73-145

FIGURE 152

MGKCSGRCTLVAFCCLQLVAALERQIFDFLGYQWAPILANFLHIMAVILGIFGTVQYRSRYLILYAAWLVLWVG
WNAFIICFYLEVGQLSQDRDFIMTFNTSLHRSWWMENGPGCLVTPVLNSRLALEDHHVISVTGCLLDYPYIEAL
SSALQIFLALFGFVFACYVSKVFLEEEDSFDFIGGFDSYGYQAPQKTSHLQLQPLYTSG

Signal sequence.

amino acids 1-21

Transmembrane domains.

amino acids 33-53, 62-82, 147-167

N-glycosylation site.

amino acids 100-103

Tyrosine kinase phosphorylation site.

amino acids 24-32

N-myristoylation sites.

amino acids 50-55, 182-187

FIGURE 153

MPAPRAREQPRVPGERQPLLPRGARGPRRWRRAAGAAVLLVEMLERAAFFGVTANLVLYLNSTNFNWTGEQATR
AALVFLGASYLLAPVGGWLADVYLGRYRAVALSLLLYLAASGLLPATAFPDGRSSFCGEMPASPLGPACPSAGC
PRSSPSPYCAPVLYAGLLLLGLAASSVRSNLTSFGADQVMDLGRDATRRFFNWFYWSINLGAVLSLLVVAFIQQ
NISFLLGYSIPVGCVGLAFFIFLFATPVFITKPPMGSQVSSMLKLALQNCCPQLWQRHSARDRQCARVLADERS
PQPGASPQEDIANFQVLVKILPVMVTLVPYWMVYFQMQSTYVLQGLHLHIPNIFPANPANISVALRAQGSSYTI
PEAWLLLANVVVVLILVPLKDRLIDPLLLRCKLLPSALQKMALGMFFGFTSVIVAGVLEMERLHYIHHNETVSQ
QIGEVLYNAAPLSIWWQIPQYLLIGISEIFASIPGLEFAYSEAPRSMQGAIMGIFFCLSGVGSLLGSSLVALLS
LPGGWLHCPKDFGNINNCRMDLYFFLLAGIQAVTALLFVWIAGRYERASQGPASHSRFSRDRG

Transmembrane domains.
amino acids 35-55, 73-93, 98-118, 157-177, 199-219, 250-270, 341-361, 369-389, 408-428, 457-477, 499-519, 537-557

N-glycosylation sites.
amino acids 61-64, 66-69, 178-181, 223-226, 356-359, 439-442

Glycosaminoglycan attachment site.
amino acids 503-506

N-myristoylation sites.
amino acids 51-56, 90-95, 116-121, 147-152, 169-174, 209-214, 258-263, 365-370, 414-419, 479-484, 493-498, 497-502, 506-511, 531-536

POT family.
amino acids 101-503

FIGURE 154

```
MWVNPEEVLLANALWITERANPYFILQRRKGHAGDGGGGGGLAGLLVGTLDVVLDSSARVAPYRILYQTPDSLV
YWTIACGGSRKEITEHWEWLEQNLLQTLSIFENENDITTFVRGKIQGIIAEYNKINDVKEDDDTEKFKEAIVKF
HRLFGMPEEEKLVNYYSCSYWKGKVPRQGWMYLSINHLCFYSFLMGREAKLVIRWVDITQLEKNATLLLPDVIK
VSTRSSEHFFSVFLNINETFKLMEQLANIAMRQLLDNEGFEQDRSLPKLKRKSPKKVSALKRDLDARAKSERYR
ALFRLPKDEKLDGHTDCTLWTPFNKMHILGQMFVSTNYICFTSKEENLCSLIIPLREVTIVEKADSSSVLPSPL
SISTRNRMTFLFANLKDRDFLVQRISDFLQQTTSKIYSDKEFAGSYNSSDDEVYSRPSSLVSSSPQRSTSSDAD
GERQFNLNGNSVPTATQTLMTMYRRRSPEEFNPKLAKEFLKEQAWKIHFAEYGQGICMYRTEKTRELVLKGIPE
SMRGELWLLLSGAINEKATHPGYYEDLVEKSMGKYNLATEEIERDLHRSLPEHPAFQNEMGIAALRRVLTAYAF
RNPNIGYCQAMNIVTSVLLLYAKEEEAFWLLVALCERMLPDYYNTRVVGALVDQGVFEELARDYVPQLYDCMQD
LGVISTISLSWFLTLFLSVMPFESAVVVVDCFFYEGIKVIFQLALAVLDANVDKLLNCKDDGEAMTVLGRYLDS
VTNKDSTLPPIPHLHSLLSDDVEPYPEVDIFRLIRTSYEKFGTIRADLIEQMRFKQRLKVIQTLEDTTKRNVVR
TIVTETSFTIDELEELYALFKAEHLTSCYWGGSSNALDRHDPSLPYLEQYRIDFEQFKGMFALLFPWACGTHSD
VLASRLFQLLDENGDSLINFREFVSGLSAACHGDLTEKLKLLYKMHVLPEPSSDQDEPDSAFEATQYFFEDITP
ECTHVVGLDSRSKQGADDGFVTVSLKPDKGKRANSQENRNYLRLWTPENKSKSKNAKDLPKLNQGQFIELCKTM
YNMFSEDPNEQELYHATAAVTSLLLEIGEVGKLFVAQPAKEGGSGGSGPSCHQGIPGVLFPKKGPGQPYVVESV
EPLPASLAPDSEEHSLGGQMEDIKLEDSSPRDNGACSSMLISDDDTKDDSSMSSYSVLSAGSHEEDKLHCEDIG
EDTVLVRSGQGTAALPRSTSLDRDWAITFEQFLASLLTEPALVKYFDKPVCMMARITSAKNIRMMGKPLTSASD
YEISAMSG
```

Transmembrane domains.
amino acids 35-55, 669-689
N-glycosylation sites.
amino acids 212-215, 239-242, 417-420, 1011-1014
Glycosaminoglycan attachment site.
amino acids 1192-1195
cAMP- and cGMP-dependent protein kinase phosphorylation sites.
amino acids 272-275, 277-280, 468-471
N-myristoylation sites.
amino acids 36-41, 37-42, 39-44, 40-45, 44-49, 414-419, 497-502, 515-520, 668-673, 782-787, 845-850, 846-851, 914-919, 977-982, 1078-1083, 1079-1084, 1082-1087, 1144-1149, 1193-1198
Amidation site.
amino acids 991-994
TBC domain.
amino acids 512-724
S-100/ICaBP type calcium.
amino acids 891-911

COMPOSITIONS AND METHODS FOR THE DIAGNOSIS AND TREATMENT OF TUMOR

RELATED APPLICATIONS

This application is a continuation of and claims priority under 35 U.S.C. § 120 to U.S. Patent Application Ser. No. 10/177,488, filed on Jun. 19, 2002now abandoned, which claims priority under 35 U.S.C. § 119(e) to U.S. Provisional Patent Application Ser. No. 60/299,500, filed on Jun. 20, 2001, U.S. Provisional Patent Application Ser. No. 60/300,880, filed on Jun. 25, 2001, U.S. Provisional Patent Application Ser. No. 60/301,880, filed on Jun. 29, 2001, U.S. Provisional Patent Application Ser. No. 60/304,813, filed on Jul. 11, 2001, U.S. Provisional Patent Application Ser. No. 60/312,312, filed on Aug. 13, 2001, U.S. Provisional Patent Application Ser. No. 60/314,280, filed on Aug. 22, 2001, U.S. Provisional Patent Application Ser. No. 60/323,268, filed on Sep. 18, 2001, U.S. Provisional Patent Application Ser. No. 60/339,227, filed on Oct. 19, 2001, U.S. Provisional Patent Application Ser. No. 60/336,827, filed on Nov. 7, 2001, U.S. Provisional Patent Application Ser. No. 60/366,869, filed on Mar. 20, 2002, and U.S. Provisional Patent Application Ser. No. 60/378,885, filed on May 8, 2002, the disclosures of which are herein incorporated by reference.

FIELD OF THE INVENTION

The present invention is directed to compositions of matter useful for the diagnosis and treatment of tumor in mammals and to methods of using those compositions of matter for the same.

BACKGROUND OF THE INVENTION

Malignant tumors (cancers) are the second leading cause of death in the United States, after heart disease (Boring et al., *CA Cancel J. Clin.* 43:7 (1993)). Cancer is characterized by the increase in the number of abnormal, or neoplastic, cells derived from a normal tissue which proliferate to form a tumor mass, the invasion of adjacent tissues by these neoplastic tumor cells, and the generation of malignant cells which eventually spread via the blood or lymphatic system to regional lymph nodes and to distant sites via a process called metastasis. In a cancerous state, a cell proliferates under conditions in which normal cells would not grow. Cancer manifests itself in a wide variety of forms, characterized by different degrees of invasiveness and aggressiveness.

In attempts to discover effective cellular targets for cancer diagnosis and therapy, researchers have sought to identify transmembrane or otherwise membrane-associated polypeptides that are specifically expressed on the surface of one or more particular type(s) of cancer cell as compared to on one or more normal non-cancerous cell(s). Often, such membrane-associated polypeptides are more abundantly expressed on the surface of the cancer cells as compared to on the surface of the non-cancerous cells. The identification of such tumor-associated cell surface antigen polypeptides has given rise to the ability to specifically target cancer cells for destruction via antibody-based therapies. In this regard, it is noted that antibody-based therapy has proved very effective in the treatment of certain cancers. For example, HERCEPTIN® and RITUXAN® (both from Genentech Inc., South San Francisco, Calif.) are antibodies that have been used successfully to treat breast cancer and non-Hodgkin's lymphoma, respectively. More specifically, HERCEPTIN® is are combinant DNA-derived humanized monoclonal antibody that selectively binds to the extracellular domain of the human epidermal growth factor receptor 2 (HER2) proto-oncogene. HER2 protein overexpression is observed in 25-30% of primary breast cancers. RITUXAN® is a genetically engineered chimeric murine/human monoclonal antibody directed against the CD20 antigen found on the surface of normal and malignant B lymphocytes. Both these antibodies are recombinantly produced in CHO cells.

In other attempts to discover effective cellular targets for cancer diagnosis and therapy, researchers have sought to identify (1) non-membrane-associated polypeptides that are specifically produced by one or more particular type(s) of cancer cell(s) as compared to by one or more particular type(s) of non-cancerous normal cell(s), (2) polypeptides that are produced by cancer cells at an expression level that is significantly higher than that of one or more normal non-cancerous cell(s), or (3) polypeptides whose expression is specifically limited to only a single (or very limited number of different) tissue type(s) in both the cancerous and non-cancerous state (e.g., normal prostate and prostate tumor tissue). Such polypeptides may remain intracellularly located or may be secreted by the cancer cell. Moreover, such polypeptides may be expressed not by the cancer cell itself, but rather by cells which produce and/or secrete polypeptides having a potentiating or growth-enhancing effect on cancer cells. Such secreted polypeptides are often proteins that provide cancer cells with a growth advantage over normal cells and include such things as, for example, angiogenic factors, cellular adhesion factors, growth factors, and the like. Identification of antagonists of such non-membrane associated polypeptides would be expected to serve as effective therapeutic agents for the treatment of such cancers. Furthermore, identification of the expression pattern of such polypeptides would be useful for the diagnosis of particular cancers in mammals.

Despite the above identified advances in mammalian cancer therapy, there is a great need for additional diagnostic and therapeutic agents capable of detecting the presence of tumor in a mammal and for effectively inhibiting neoplastic cell growth, respectively. Accordingly, it is an objective of the present invention to identify: (1) cell membrane-associated polypeptides that are more abundantly expressed on one or more type(s) of cancer cell(s) as compared to on normal cells or on other different cancer cells, (2) non-membrane-associated polypeptides that are specifically produced by one or more particular type(s) of cancer cell(s) (or by other cells that produce polypeptides having a potentiating effect on the growth of cancer cells) as compared to by one or more particular type(s) of non-cancerous normal cell(s), (3) non-membrane-associated polypeptides that are produced by cancer cells at an expression level that is significantly higher than that of one or more normal non-cancerous cell(s), or (4) polypeptides whose expression is specifically limited to only a single (or very limited number of different) tissue type(s) in both a cancerous and non-cancerous state (e.g., normal prostate and prostate tumor tissue), and to use those polypeptides, and their encoding nucleic acids, to produce compositions of matter useful in the therapeutic treatment and diagnostic detection of cancer in mammals. It is also an objective of the present invention to identify cell membrane-associated, secreted or intracellular polypeptides whose expression is limited to a single or very limited number of tissues, and to use those polypeptides, and their encoding nucleic acids, to produce compositions of matter useful in the therapeutic treatment and diagnostic detection of cancer in mammals.

SUMMARY OF THE INVENTION

A. Embodiments

In the present specification, Applicants describe for the first time the identification of various cellular polypeptides (and their encoding nucleic acids or fragments thereof) which are expressed to a greater degree on the surface of or by one or more types of cancer cell(s) as compared to on the surface of or by one or more types of normal non-cancer cells. Alternatively, such polypeptides are expressed by cells which produce and/or secrete polypeptides having a potentiating or growth-enhancing effect on cancer cells. Again alternatively, such polypeptides may not be overexpressed by tumor cells as compared to normal cells of the same tissue type, but rather may be specifically expressed by both tumor cells and normal cells of only a single or very limited number of tissue types (preferably tissues which are not essential for life, e.g., prostate, etc.). All of the above polypeptides are herein referred to as Tumor-associated Antigenic Target polypeptides ("TAT" polypeptides) and are expected to serve as effective targets for cancer therapy and diagnosis in mammals.

Accordingly, in one embodiment of the present invention, the invention provides an isolated nucleic acid molecule having a nucleotide sequence that encodes a tumor-associated antigenic target polypeptide or fragment thereof (a "TAT" polypeptide).

In certain aspects, the isolated nucleic acid molecule comprises a nucleotide sequence having at least about 80% nucleic acid sequence identity, alternatively at least about 81%, 82%, 83%, 84%, 85%, 86%, 87%, 88%, 89%, 90%, 91%, 92%, 93%, 94%, 95%, 96%, 97%, 98%, 99% or 100% nucleic acid sequence identity, to (a) a DNA molecule encoding a full-length TAT polypeptide having an amino acid sequence as disclosed herein, a TAT polypeptide amino acid sequence lacking the signal peptide as disclosed herein, an extracellular domain of a transmembrane TAT polypeptide, with or without the signal peptide, as disclosed herein or any other specifically defined fragment of a full-length TAT polypeptide amino acid sequence as disclosed herein, or (b) the complement of the DNA molecule of (a).

In other aspects, the isolated nucleic acid molecule comprises a nucleotide sequence having at least about 80% nucleic acid sequence identity, alternatively at least about 81%, 82%, 83%, 84%, 85%, 86%, 87%, 88%, 89%, 90%, 91%, 92%, 93%, 94%, 95%, 96%, 97%, 98%, 99% or 100% nucleic acid sequence identity, to (a) a DNA molecule comprising the coding sequence of a full-length TAT polypeptide cDNA as disclosed herein, the coding sequence of a TAT polypeptide lacking the signal peptide as disclosed herein, the coding sequence of an extracellular domain of a transmembrane TAT polypeptide, with or without the signal peptide, as disclosed herein or the coding sequence of any other specifically defined fragment of the full-length TAT polypeptide amino acid sequence as disclosed herein, or (b) the complement of the DNA molecule of (a).

In further aspects, the invention concerns an isolated nucleic acid molecule comprising a nucleotide sequence having at least about 80% nucleic acid sequence identity, alternatively at least about 81%, 82%, 83%, 84%, 85%, 86%, 87%, 88%, 89%, 90%, 91%, 92%, 93%, 94%, 95%, 96%, 97%, 98%, 99% or 100% nucleic acid sequence identity, to (a) a DNA molecule that encodes the same mature polypeptide encoded by the full-length coding region of any of the human protein cDNAs deposited with the ATCC as disclosed herein, or (b) the complement of the DNA molecule of (a).

Another aspect of the invention provides an isolated nucleic acid molecule comprising a nucleotide sequence encoding a TAT polypeptide which is either transmembrane domain-deleted or transmembrane domain-inactivated, or is complementary to such encoding nucleotide sequence, wherein the transmembrane domain(s) of such polypeptide(s) are disclosed herein. Therefore, soluble extracellular domains of the herein described TAT polypeptides are contemplated.

In other aspects, the present invention is directed to isolated nucleic acid molecules which hybridize to (a) a nucleotide sequence encoding a TAT polypeptide having a full-length amino acid sequence as disclosed herein, a TAT polypeptide amino acid sequence lacking the signal peptide as disclosed herein, an extracellular domain of a transmembrane TAT polypeptide, with or without the signal peptide, as disclosed herein or any other specifically defined fragment of a full-length TAT polypeptide amino acid sequence as disclosed herein, or (b) the complement of the nucleotide sequence of (a). In this regard, an embodiment of the present invention is directed to fragments of a full-length TAT polypeptide coding sequence, or the complement thereof, as disclosed herein, that may find use as, for example, hybridization probes useful as, for example, diagnostic probes, antisense oligonucleotide probes, or for encoding fragments of a full-length TAT polypeptide that may optionally encode a polypeptide comprising a binding site for an anti-TAT polypeptide antibody, a TAT binding oligopeptide or other small organic molecule that binds to a TAT polypeptide. Such nucleic acid fragments are usually at least about 5 nucleotides in length, alternatively at least about 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleotides in length, wherein in this context the term "about" means the referenced nucleotide sequence length plus or minus 10% of that referenced length. It is noted that novel fragments of a TAT polypeptide-encoding nucleotide sequence may be determined in a routine manner by aligning the TAT polypeptide-encoding nucleotide sequence with other known nucleotide sequences using any of a number of well known sequence alignment programs and determining which TAT polypeptide-encoding nucleotide sequence fragment(s) are novel. All of such novel fragments of TAT polypeptide-encoding nucleotide sequences are contemplated herein. Also contemplated are the TAT polypeptide fragments encoded by these nucleotide molecule fragments, preferably those TAT polypeptide fragments that comprise a binding site for an anti-TAT antibody, a TAT binding oligopeptide or other small organic molecule that binds to a TAT polypeptide.

In another embodiment, the invention provides isolated TAT polypeptides encoded by any of the isolated nucleic acid sequences hereinabove identified.

In a certain aspect, the invention concerns an isolated TAT polypeptide, comprising an amino acid sequence having at least about 80% amino acid sequence identity, alternatively at least about 81%, 82%, 83%, 84%, 85%, 86%, 87%, 88%, 89%, 90%, 91%, 92%, 93%, 94%, 95%, 96%, 97%, 98%, 99% or 100%, amino acid sequence identity, to a TAT polypeptide having a full-length amino acid sequence as disclosed herein, a TAT polypeptide amino acid sequence lacking the signal peptide as disclosed herein, an extracellular domain of a transmembrane TAT polypeptide protein, with or without the signal peptide, as disclosed herein, an amino acid sequence encoded by any of the nucleic acid sequences disclosed herein or any other specifically defined fragment of a full-length TAT polypeptide amino acid sequence as disclosed herein.

In a further aspect, the invention concerns an isolated TAT polypeptide comprising an amino acid sequence having at least about 80% amino acid sequence identity, alternatively at least about 81%, 82%, 83%, 84%, 85%, 86%, 87%, 88%, 89%, 90%, 91%, 92%, 93%, 94%, 95%, 96%, 97%, 98% or 99% amino acid sequence identity, to an amino acid sequence encoded by any of the human protein cDNAs deposited with the ATCC as disclosed herein.

In a specific aspect, the invention provides an isolated TAT polypeptide without the N-terminal signal sequence and/or without the initiating methionine and is encoded by a nucleotide sequence that encodes such an amino acid sequence as hereinbefore described. Processes for producing the same are also herein described, wherein those processes comprise culturing a host cell comprising a vector which comprises the appropriate encoding nucleic acid molecule under conditions suitable for expression of the TAT polypeptide and recovering the TAT polypeptide from the cell culture.

Another aspect of the invention provides an isolated TAT polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the TAT polypeptide and recovering the TAT polypeptide from the cell culture.

In other embodiments of the present invention, the invention provides vectors comprising DNA encoding any of the herein described polypeptides. Host cells comprising any such vector are also provided. By way of example, the host cells may be CHO cells, E. coli cells, or yeast cells. A process for producing any of the herein described polypeptides is further provided and comprises culturing host cells under conditions suitable for expression of the desired polypeptide and recovering the desired polypeptide from the cell culture.

In other embodiments, the invention provides isolated chimeric polypeptides comprising any of the herein described TAT polypeptides fused to a heterologous (non-TAT) polypeptide. Example of such chimeric molecules comprise any of the herein described TAT polypeptides fused to a heterologous polypeptide such as, for example, an epitope tag sequence or a Fc region of an immunoglobulin.

In another embodiment, the invention provides an antibody which binds, preferably specifically, to any of the above or below described polypeptides. Optionally, the antibody is a monoclonal antibody, antibody fragment, chimeric antibody, humanized antibody, single-chain antibody or antibody that competitively inhibits the binding of an anti-TAT polypeptide antibody to its respective antigenic epitope. Antibodies of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies of the present invention may optionally be produced in CHO cells or bacterial cells and preferably induce death of a cell to which they bind. For diagnostic purposes, the antibodies of the present invention may be detectably labeled, attached to a solid support, or the like.

In other embodiments of the present invention, the invention provides vectors comprising DNA encoding any of the herein described antibodies. Host cell comprising any such vector are also provided. By way of example, the host cells may be CHO cells, E. coli cells, or yeast cells. A process for producing any of the herein described antibodies is further provided and comprises culturing host cells under conditions suitable for expression of the desired antibody and recovering the desired antibody from the cell culture.

In another embodiment, the invention provides oligopeptides ("TAT binding oligopeptides") which bind, preferably specifically, to any of the above or below described TAT polypeptides. Optionally, the TAT binding oligopeptides of the present invention may be conjugated to a growth inhibitory agent or cytotoxic agent such as a toxin, including, for example, a maytansinoid or calicheamicin, an antibiotic, a radioactive isotope, a nucleolytic enzyme, or the like. The TAT binding oligopeptides of the present invention may optionally be produced in CHO cells or bacterial cells and preferably induce death of a cell to which they bind. For diagnostic purposes, the TAT binding oligopeptides of the present invention may be detectably labeled, attached to a solid support, or the like.

In other embodiments of the present invention, the invention provides vectors comprising DNA encoding any of the herein described TAT binding oligopeptides. Host cell comprising any such vector are also provided. By way of example, the host cells may be CHO cells, E. coli cells, or yeast cells. A process for producing any of the herein described TAT binding oligopeptides is further provided and comprises culturing host cells under conditions suitable for expression of the desired oligopeptide and recovering the desired oligopeptide from the cell culture.

In another embodiment, the invention provides small organic molecules ("TAT binding organic molecules") which bind, preferably specifically, to any of the above or below described TAT polypeptides. Optionally, the TAT binding organic molecules of the present invention may be conjugated to a growth inhibitory agent or cytotoxic agent such as a toxin, including, for example, a maytansinoid or calicheamicin, an antibiotic, a radioactive isotope, a nucleolytic enzyme, or the like. The TAT binding organic molecules of the present invention preferably induce death of a cell to which they bind. For diagnostic purposes, the TAT binding organic molecules of the present invention may be detectably labeled, attached to a solid support, or the like.

In a still further embodiment, the invention concerns a composition of matter comprising a TAT polypeptide as described herein, a chimeric TAT polypeptide as described herein, an anti-TAT antibody as described herein, a TAT binding oligopeptide as described herein, or a TAT binding organic molecule as described herein, in combination with a carrier. Optionally, the carrier is a pharmaceutically acceptable carrier.

In yet another embodiment, the invention concerns an article of manufacture comprising a container and a composition of matter contained within the container, wherein the composition of matter may comprise a TAT polypeptide as described herein, a chimeric TAT polypeptide as described herein, an anti-TAT antibody as described herein, a TAT binding oligopeptide as described herein, or a TAT binding organic molecule as described herein. The article may further optionally comprise a label affixed to the container, or a package insert included with the container, that refers to the use of the composition of matter for the therapeutic treatment or diagnostic detection of a tumor.

Another embodiment of the present invention is directed to the use of a TAT polypeptide as described herein, a chimeric TAT polypeptide as described herein, an anti-TAT polypeptide antibody as described herein, a TAT binding oligopeptide as described herein, or a TAT binding organic molecule as described herein, for the preparation of a medicament useful in the treatment of a condition which is responsive to the TAT polypeptide, chimeric TAT polypeptide, anti-TAT polypeptide antibody, TAT binding oligopeptide, or TAT binding organic molecule.

B. Additional Embodiments

Another embodiment of the present invention is directed to a method for inhibiting the growth of a cell that expresses a TAT polypeptide, wherein the method comprises contacting the cell with an antibody, an oligopeptide or a small organic molecule that binds to the TAT polypeptide, and wherein the binding of the antibody, oligopeptide or organic molecule to the TAT polypeptide causes inhibition of the growth of the cell expressing the TAT polypeptide. In preferred embodiments, the cell is a cancer cell and binding of the antibody, oligopeptide or organic molecule to the TAT polypeptide causes death of the cell expressing the TAT polypeptide. Optionally, the antibody is a monoclonal antibody, antibody fragment, chimeric antibody, humanized antibody, or single-chain antibody. Antibodies, TAT binding oligopeptides and TAT binding organic molecules employed in the methods of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies and TAT binding oligopeptides employed in the methods of the present invention may optionally be produced in CHO cells or bacterial cells.

Yet another embodiment of the present invention is directed to a method of therapeutically treating a mammal having a cancerous tumor comprising cells that express a TAT polypeptide, wherein the method comprises administering to the mammal a therapeutically effective amount of an antibody, an oligopeptide or a small organic molecule that binds to the TAT polypeptide, thereby resulting in the effective therapeutic treatment of the tumor. Optionally, the antibody is a monoclonal antibody, antibody fragment, chimeric antibody, humanized antibody, or single-chain antibody. Antibodies, TAT binding oligopeptides and TAT binding organic molecules employed in the methods of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies and oligopeptides employed in the methods of the present invention may optionally be produced in CHO cells or bacterial cells.

Yet another embodiment of the present invention is directed to a method of determining the presence of a TAT polypeptide in a sample suspected of containing the TAT polypeptide, wherein the method comprises exposing the sample to an antibody, oligopeptide or small organic molecule that binds to the TAT polypeptide and determining binding of the antibody, oligopeptide or organic molecule to the TAT polypeptide in the sample, wherein the presence of such binding is indicative of the presence of the TAT polypeptide in the sample. Optionally, the sample may contain cells (which may be cancer cells) suspected of expressing the TAT polypeptide. The antibody, TAT binding oligopeptide or TAT binding organic molecule employed in the method may optionally be detectably labeled, attached to a solid support, or the like.

A further embodiment of the present invention is directed to a method of diagnosing the presence of a tumor in a mammal, wherein the method comprises detecting the level of expression of a gene encoding a TAT polypeptide (a) in a test sample of tissue cells obtained from said mammal, and (b) in a control sample of known normal non-cancerous cells of the same tissue origin or type, wherein a higher level of expression of the TAT polypeptide in the test sample, as compared to the control sample, is indicative of the presence of tumor in the mammal from which the test sample was obtained.

Another embodiment of the present invention is directed to a method of diagnosing the presence of a tumor in a mammal, wherein the method comprises (a) contacting a test sample comprising tissue cells obtained from the mammal with an antibody, oligopeptide or small organic molecule that binds to a TAT polypeptide and (b) detecting the formation of a complex between the antibody, oligopeptide or small organic molecule and the TAT polypeptide in the test sample, wherein the formation of a complex is indicative of the presence of a tumor in the mammal. Optionally, the antibody, TAT binding oligopeptide or TAT binding organic molecule employed is detectably labeled, attached to a solid support, or the like, and/or the test sample of tissue cells is obtained from an individual suspected of having a cancerous tumor.

Yet another embodiment of the present invention is directed to a method for treating or preventing a cell proliferative disorder associated with altered, preferably increased, expression or activity of a TAT polypeptide, the method comprising administering to a subject in need of such treatment an effective amount of an antagonist of a TAT polypeptide. Preferably, the cell proliferative disorder is cancer and the antagonist of the TAT polypeptide is an anti-TAT polypeptide antibody, TAT binding oligopeptide, TAT binding organic molecule or antisense oligonucleotide. Effective treatment or prevention of the cell proliferative disorder may be a result of direct killing or growth inhibition of cells that express a TAT polypeptide or by antagonizing the cell growth potentiating activity of a TAT polypeptide.

Yet another embodiment of the present invention is directed to a method of binding an antibody, oligopeptide or small organic molecule to a cell that expresses a TAT polypeptide, wherein the method comprises contacting a cell that expresses a TAT polypeptide with said antibody, oligopeptide or small organic molecule under conditions which are suitable for binding of the antibody, oligopeptide or small organic molecule to said TAT polypeptide and allowing binding therebetween.

Other embodiments of the present invention are directed to the use of (a) a TAT polypeptide, (b) a nucleic acid encoding a TAT polypeptide or a vector or host cell comprising that nucleic acid, (c) an anti-TAT polypeptide antibody, (d) a TAT-binding oligopeptide, or (e) a TAT-binding small organic molecule in the preparation of a medicament useful for (i) the therapeutic treatment or diagnostic detection of a cancer or tumor, or (ii) the therapeutic treatment or prevention of a cell proliferative disorder.

Another embodiment of the present invention is directed to a method for inhibiting the growth of a cancer cell, wherein the growth of said cancer cell is at least in part dependent upon the growth potentiating effect(s) of a TAT polypeptide (wherein the TAT polypeptide may be expressed either by the cancer cell itself or a cell that produces polypeptide(s) that have a growth potentiating effect on cancer cells), wherein the method comprises contacting the TAT polypeptide with an antibody, an oligopeptide or a small organic molecule that binds to the TAT polypeptide, thereby antagonizing the growth-potentiating activity of the TAT polypeptide and, in turn, inhibiting the growth of the cancer cell. Preferably the growth of the cancer cell is completely inhibited. Even more preferably, binding of the antibody, oligopeptide or small organic molecule to the TAT polypeptide induces the death of the cancer cell. Optionally, the antibody is a monoclonal antibody, antibody fragment, chimeric antibody, humanized antibody, or single-chain antibody. Antibodies, TAT binding oligopeptides and TAT binding organic molecules employed in the methods of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies and TAT binding oligopeptides employed in the methods of the present invention may optionally be produced in CHO cells or bacterial cells.

Yet another embodiment of the present invention is directed to a method of therapeutically treating a tumor in a mammal, wherein the growth of said tumor is at least in part dependent upon the growth potentiating effect(s) of a TAT polypeptide, wherein the method comprises administering to the mammal a therapeutically effective amount of an antibody, an oligopeptide or a small organic molecule that binds to the TAT polypeptide, thereby antagonizing the growth potentiating activity of said TAT polypeptide and resulting in the effective therapeutic treatment of the tumor. Optionally, the antibody is a monoclonal antibody, antibody fragment, chimeric antibody, humanized antibody, or single-chain antibody. Antibodies, TAT binding oligopeptides and TAT binding organic molecules employed in the methods of the present invention may optionally be conjugated to a growth inhibitory agent or cytotoxic agent such as a toxin, including, for example, a maytansinoid or calicheamicin, an antibiotic, a radioactive isotope, a nucleolytic enzyme, or the like. The antibodies and oligopeptides employed in the methods of the present invention may optionally be produced in CHO cells or bacterial cells.

C. Further Additional Embodiments

In yet further embodiments, the invention is directed to the following set of potential claims for this application:

1. Isolated nucleic acid having a nucleotide sequence that has at least 80% nucleic acid sequence identity to:
    (a) a DNA molecule encoding the amino acid sequence shown in any one of FIGS. 79 to 154 (SEQ ID NOS:79-154);
    (b) a DNA molecule encoding the amino acid sequence shown in any one of FIGS. 79 to 154 (SEQ ID NOS:79-154), lacking its associated signal peptide;
    (c) a DNA molecule encoding an extracellular domain of the polypeptide shown in any one of FIGS. 79 to 154 (SEQ ID NOS:79-154), with its associated signal peptide;
    (d) a DNA molecule encoding an extracellular domain of the polypeptide shown in any one of FIGS. 79 to 154 (SEQ ID NOS:79-154), lacking its associated signal peptide;
    (e) the nucleotide sequence shown in any one of FIGS. 1 to 78A-B (SEQ ID NOS: 1-78);
    (f) the full-length coding region of the nucleotide sequence shown in any one of FIGS. 1 to 78A-B (SEQ ID NOS:1-78); or
    (g) the complement of (a), (b), (c), (d), (e) or (f).

2. Isolated nucleic acid having:
    (a) a nucleotide sequence that encodes the amino acid sequence shown in any one of FIGS. 79 to 154 (SEQ ID NOS:79-154);
    (b) a nucleotide sequence that encodes the amino acid sequence shown in any one of FIGS. 79 to 154 (SEQ ID NOS:79-154), lacking its associated signal peptide;
    (c) a nucleotide sequence that encodes an extracellular domain of the polypeptide shown in any one of FIGS. 79 to 154 (SEQ ID NOS:79-154), with its associated signal peptide;
    (d) a nucleotide sequence that encodes an extracellular domain of the polypeptide shown in any one of FIGS. 79 to 154 (SEQ ID NOS:79-154), lacking its associated signal peptide;
    (e) the nucleotide sequence shown in any one of FIGS. 1 to 78A-B (SEQ ID NOS: 1-78);
    (f) the full-length coding region of the nucleotide sequence shown in any one of FIGS. 1 to 78A-B (SEQ ID NOS: 1-78); or
    (g) the complement of (a), (b), (c), (d), (e) or (f).

3. Isolated nucleic acid that hybridizes to:
    (a) a nucleic acid that encodes the amino acid sequence shown in any one of FIGS. 79 to 154 (SEQ ID NOS:79-154);
    (b) a nucleic acid that encodes the amino acid sequence shown in any one of FIGS. 79 to 154 (SEQ ID NOS:79-154), lacking its associated signal peptide;
    (c) a nucleic acid that encodes an extracellular domain of the polypeptide shown in any one of FIGS. 79 to 154 (SEQ ID NOS:79-154), with its associated signal peptide;
    (d) a nucleic acid that encodes an extracellular domain of the polypeptide shown in any one of FIGS. 79 to 154 (SEQ ID NOS:79-154), lacking its associated signal peptide;
    (e) the nucleotide sequence shown in any one of FIGS. 1 to 78A-B (SEQ ID NOS: 1-78);
    (f) the full-length coding region of the nucleotide sequence shown in any one of FIGS. 1 to 78A-B (SEQ ID NOS: 1-78); or
    (g) the complement of (a), (b), (c), (d), (e) or (f).

4. The nucleic acid of claim 3, wherein the hybridization occurs under stringent conditions.

5. The nucleic acid of claim 3 which is at least about 5 nucleotides in length.

6. An expression vector comprising the nucleic acid of claim 1, 2 or 3.

7. The expression vector of claim 6, wherein said nucleic acid is operably linked to control sequences recognized by a host cell transformed with the vector.

8. A host cell comprising the expression vector of claim 7.

9. The host cell of claim 8 which is a CHO cell, an *E. coli* cell or a yeast cell.

10. A process for producing a polypeptide comprising culturing the host cell of claim 8 under conditions suitable for expression of said polypeptide and recovering said polypeptide from the cell culture.

11. An isolated polypeptide having at least 80% amino acid sequence identity to:
    (a) the polypeptide shown in any one of FIGS. 79 to 154 (SEQ ID NOS:79-154);
    (b) the polypeptide shown in any one of FIGS. 79 to 154 (SEQ ID NOS:79-154), lacking its associated signal peptide;
    (c) an extracellular domain of the polypeptide shown in any one of FIGS. 79 to 154 (SEQ ID NOS:79-154), with its associated signal peptide;
    (d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS: 1-78); or (f) a polypeptide encoded by the full-length coding region of the nucleotide sequence shown in any one of FIGS. 1 to 78A-B (SEQ ID NOS: 1-78).

12. An isolated polypeptide having:

(a) the amino acid sequence shown in any one of FIGS. 79 to 154 (SEQ ID NOS:79-154);

(b) the amino acid sequence shown in any one of FIGS. 79 to 154 (SEQ ID NOS:79-154), lacking its associated signal peptide sequence;

(c) an amino acid sequence of an extracellular domain of the polypeptide shown in any one of FIGS. 79 to 154 (SEQ ID NOS:79-154), with its associated signal peptide sequence;

(d) an amino acid sequence of an extracellular domain of the polypeptide shown in any one of FIGS. 79 to 154 (SEQ ID NOS:79-154), lacking its associated signal peptide sequence;

(e) an amino acid sequence encoded by the nucleotide sequence shown in any one of FIGS. 1 to 78A-B (SEQ ID NOS:1-78); or (f) an amino acid sequence encoded by the full-length coding region of the nucleotide sequence shown in any one of FIGS. 1 to 78A-B (SEQ ID NOS:1-78).

13. A chimeric polypeptide comprising the polypeptide of claim 11 or 12 fused to a heterologous polypeptide.

14. The chimeric polypeptide of claim 13, wherein said heterologous polypeptide is an epitope tag sequence or an Fc region of an immunoglobulin.

15. An isolated antibody that binds to a polypeptide having at least 80% amino acid sequence identity to:

(a) the polypeptide shown in any one of FIGS. 79 to 154 (SEQ ID NOS:79-154);

(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS: 1-78).

16. An isolated antibody that binds to a polypeptide having:

(a) the amino acid sequence shown in any one of FIGS. 79 to 154 (SEQ ID NOS:79-154);

(b) the amino acid sequence shown in any one of FIGS. 79 to 154 (SEQ ID NOS:79-154), lacking its associated signal peptide sequence;

(c) an amino acid sequence of an extracellular domain of the polypeptide shown in any one of FIGS. 79 to 154 (SEQ ID NOS:79-154), with its associated signal peptide sequence;

(d) an amino acid sequence of an extracellular domain of the polypeptide shown in any one of FIGS. 79 to 154 (SEQ ID NOS:79-154), lacking its associated signal peptide sequence;

(e) an amino acid sequence encoded by the nucleotide sequence shown in any one of FIGS. 1 to 78A-B (SEQ ID NOS:1-78); or (f) an amino acid sequence encoded by the full-length coding region of the nucleotide sequence shown in any one of FIGS. 1 to 78A-B (SEQ ID NOS: 1-78).

17. The antibody of claim 15 or 16 which is a monoclonal antibody.

18. The antibody of claim 15 or 16 which is an antibody fragment.

19. The antibody of claim 15 or 16 which is a chimeric or a humanized antibody.

20. The antibody of claim 15 or 16 which is conjugated to a growth inhibitory agent.

21. The antibody of claim 15 or 16 which is conjugated to a cytotoxic agent.

22. The antibody of claim 21, wherein the cytotoxic agent is selected from the group consisting of toxins, antibiotics, radioactive isotopes and nucleolytic enzymes.

23. The antibody of claim 21, wherein the cytotoxic agent is a toxin.

24. The antibody of claim 23, wherein the toxin is selected from the group consisting of maytansinoid and calicheamicin.

25. The antibody of claim 23, wherein the toxin is a maytansinoid.

26. The antibody of claim 15 or 16 which is produced in bacteria.

27. The antibody of claim 15 or 16 which is produced in CHO cells.

28. The antibody of claim 15 or 16 which induces death of a cell to which it binds.

29. The antibody of claim 15 or 16 which is detectably labeled.

30. An isolated nucleic acid having a nucleotide sequence that encodes the antibody of claim 15 or 16.

31. An expression vector comprising the nucleic acid of claim 30 operably linked to control sequences recognized by a host cell transformed with the vector.

32. A host cell comprising the expression vector of claim 31.

33. The host cell of claim 32 which is a CHO cell, an *E. coli* cell or a yeast cell.

34. A process for producing an antibody comprising culturing the host cell of claim 32 under conditions suitable for expression of said antibody and recovering said antibody from the cell culture.

35. An isolated oligopeptide that binds to a polypeptide having at least 80% amino acid sequence identity to:

(a) the polypeptide shown in any one of FIGS. 79 to 154 (SEQ ID NOS:79-154);

(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS: 1-78).

36. An isolated oligopeptide that binds to a polypeptide having:

(a) the amino acid sequence shown in any one of FIGS. 79 to 154 (SEQ ID NOS:79-154);

(b) the amino acid sequence shown in any one of FIGS. 79 to 154 (SEQ ID NOS:79-154), lacking its associated signal peptide sequence;

(c) an amino acid sequence of an extracellular domain of the polypeptide shown in any one of FIGS. 79 to 154 (SEQ ID NOS:79-154), with its associated signal peptide sequence;

(d) an amino acid sequence of an extracellular domain of the polypeptide shown in any one of FIGS. 79 to 154 (SEQ ID NOS:79-154), lacking its associated signal peptide sequence;

(e) an amino acid sequence encoded by the nucleotide sequence shown in any one of FIGS. 1 to 78A-B (SEQ ID NOS:1-78); or (f) an amino acid sequence encoded by the full-length coding region of the nucleotide sequence shown in any one of FIGS. 1 to 78A-B (SEQ ID NOS:1-78).

37. The oligopeptide of claim 35 or 36 which is conjugated to a growth inhibitory agent.

38. The oligopeptide of claim 35 or 36 which is conjugated to a cytotoxic agent.

39. The oligopeptide of claim 38, wherein the cytotoxic agent is selected from the group consisting of toxins, antibiotics, radioactive isotopes and nucleolytic enzymes.

40. The oligopeptide of claim 38, wherein the cytotoxic agent is a toxin.

41. The oligopeptide of claim 40, wherein the toxin is selected from the group consisting of maytansinoid and calicheamicin.

42. The oligopeptide of claim 40, wherein the toxin is a maytansinoid.

43. The oligopeptide of claim 35 or 36 which induces death of a cell to which it binds.

44. The oligopeptide of claim 35 or 36 which is detectably labeled.

45. A TAT binding organic molecule that binds to a polypeptide having at least 80% amino acid sequence identity to:

(a) the polypeptide shown in any one of FIGS. 79 to 154 (SEQ ID NOS:79-154);

(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS:1-78).

46. The organic molecule of claim 45 that binds to a polypeptide having:

(a) the amino acid sequence shown in any one of FIGS. 79 to 154 (SEQ ID NOS:79-154);

(b) the amino acid sequence shown in any one of FIGS. 79 to 154 (SEQ ID NOS:79-154), lacking its associated signal peptide sequence;

(c) an amino acid sequence of an extracellular domain of the polypeptide shown in any one of FIGS. 79 to 154 (SEQ ID NOS:79-154), with its associated signal peptide sequence;

(d) an amino acid sequence of an extracellular domain of the polypeptide shown in any one of FIGS. 79 to 154 (SEQ ID NOS:79-154), lacking its associated signal peptide sequence;

(e) an amino acid sequence encoded by the nucleotide sequence shown in any one of FIGS. 1 to 78A-B (SEQ ID NOS: 1-78); or (f) an amino acid sequence encoded by the full-length coding region of the nucleotide sequence shown in any one of FIGS. 1 to 78A-B (SEQ ID NOS:1-78).

47. The organic molecule of claim 45 or 46 which is conjugated to a growth inhibitory agent.

48. The organic molecule of claim 45 or 46 which is conjugated to a cytotoxic agent.

49. The organic molecule of claim 48, wherein the cytotoxic agent is selected from the group consisting of toxins, antibiotics, radioactive isotopes and nucleolytic enzymes.

50. The organic molecule of claim 48, wherein the cytotoxic agent is a toxin.

51. The organic molecule of claim 50, wherein the toxin is selected from the group consisting of maytansinoid and calicheamicin.

52. The organic molecule of claim 50, wherein the toxin is a maytansinoid.

53. The organic molecule of claim 45 or 46 which induces death of a cell to which it binds.

54. The organic molecule of claim 45 or 46 which is detectably labeled.

55. A composition of matter comprising:

(a) the polypeptide of claim 11;
(b) the polypeptide of claim 12;
(c) the chimeric polypeptide of claim 13;
(d) the antibody of claim 15;
(e) the antibody of claim 16;
(f) the oligopeptide of claim 35;
(g) the oligopeptide of claim 36;
(h) the TAT binding organic molecule of claim 45; or
(i) the TAT binding organic molecule of claim 46; in combination with a carrier.

56. The composition of matter of claim 55, wherein said carrier is a pharmaceutically acceptable carrier.

57. An article of manufacture comprising:

(a) a container; and
(b) the composition of matter of claim 55 contained within said container.

58. The article of manufacture of claim 57 further comprising a label affixed to said container, or a package insert included with said container, referring to the use of said composition of matter for the therapeutic treatment of or the diagnostic detection of a cancer.

59. A method of inhibiting the growth of a cell that expresses a protein having at least 80% amino acid sequence identity to:

(a) the polypeptide shown in any one of FIGS. 79 to 154 (SEQ ID NOS:79-154);

(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS:1-78), said method comprising contacting said cell with an antibody, oligopeptide or organic molecule that binds to said protein, the binding of said antibody, oligopeptide or organic molecule to said protein thereby causing an inhibition of growth of said cell.

60. The method of claim 59, wherein said antibody is a monoclonal antibody.

61. The method of claim 59, wherein said antibody is an antibody fragment.

62. The method of claim 59, wherein said antibody is a chimeric or a humanized antibody.

63. The method of claim 59, wherein said antibody, oligopeptide or organic molecule is conjugated to a growth inhibitory agent.

64. The method of claim 59, wherein said antibody, oligopeptide or organic molecule is conjugated to a cytotoxic agent.

65. The method of claim 64, wherein said cytotoxic agent is selected from the group consisting of toxins, antibiotics, radioactive isotopes and nucleolytic enzymes.

66. The method of claim 64, wherein the cytotoxic agent is a toxin.

67. The method of claim 66, wherein the toxin is selected from the group consisting of maytansinoid and calicheamicin.

68. The method of claim 66, wherein the toxin is a maytansinoid.

69. The method of claim 59, wherein said antibody is produced in bacteria.

70. The method of claim 59, wherein said antibody is produced in CHO cells.

71. The method of claim 59, wherein said cell is a cancer cell.

72. The method of claim 71, wherein said cancer cell is further exposed to radiation treatment or a chemotherapeutic agent.

73. The method of claim 71, wherein said cancer cell is selected from the group consisting of a breast cancer cell, a colorectal cancer cell, a lung cancer cell, an ovarian cancer cell, a central nervous system cancer cell, a liver cancer cell, a bladder cancer cell, a pancreatic cancer cell, a cervical cancer cell, a melanoma cell and a leukemia cell.

74. The method of claim 71, wherein said protein is more abundantly expressed by said cancer cell as compared to a normal cell of the same tissue origin.

75. The method of claim 59 which causes the death of said cell.

76. The method of claim 59, wherein said protein has:
(a) the amino acid sequence shown in any one of FIGS. 79 to 154 (SEQ ID NOS:79-154);
(b) the amino acid sequence shown in any one of FIGS. 79 to 154 (SEQ ID NOS:79-154), lacking its associated signal peptide sequence;
(c) an amino acid sequence of an extracellular domain of the polypeptide shown in any one of FIGS. 79 to 154 (SEQ ID NOS:79-154), with its associated signal peptide sequence;
(d) an amino acid sequence of an extracellular domain of the polypeptide shown in any one of FIGS. 79 to 154 (SEQ ID NOS:79-154), lacking its associated signal peptide sequence;
(e) an amino acid sequence encoded by the nucleotide sequence shown in any one of FIGS. 1 to 78A-B (SEQ ID NOS:1-78); or (
f) an amino acid sequence encoded by the full-length coding region of the nucleotide sequence shown in any one of FIGS. 1 to 78A-B (SEQ ID NOS:1-78).

77. A method of therapeutically treating a mammal having a cancerous tumor comprising cells that express a protein having at least 80% amino acid sequence identity to:
(a) the polypeptide shown in any one of FIGS. 79 to 154 (SEQ ID NOS:79-154);
(b) the polypeptide shown in any one of FIGS. 79 to 154 (SEQ ID NOS:79-154), lacking its associated signal peptide;
(c) an extracellular domain of the polypeptide shown in any one of FIGS. 79 to 154 (SEQ ID NOS:79-154), with its associated signal peptide;
(d) an extracellular domain of the polypeptide shown in any one of FIGS. 79 to 154 (SEQ ID NOS:79-154), lacking its associated signal peptide;
(e) a polypeptide encoded by the nucleotide sequence shown in any one of FIGS. 1 to 78A-B (SEQ ID NOS:1-78); or
(f) a polypeptide encoded by the full-length coding region of the nucleotide sequence shown in any one of FIGS. 1 to 78A-B (SEQ ID NOS:1-78), said method comprising administering to said mammal a therapeutically effective amount of an antibody, oligopeptide or organic molecule that binds to said protein, thereby effectively treating said mammal.

78. The method of claim 77, wherein said antibody is a monoclonal antibody.

79. The method of claim 77, wherein said antibody is an antibody fragment.

80. The method of claim 77, wherein said antibody is a chimeric or a humanized antibody.

81. The method of claim 77, wherein said antibody, oligopeptide or organic molecule is conjugated to a growth inhibitory agent.

82. The method of claim 77, wherein said antibody, oligopeptide or organic molecule is conjugated to a cytotoxic agent.

83. The method of claim 82, wherein said cytotoxic agent is selected from the group consisting of toxins, antibiotics, radioactive isotopes and nucleolytic enzymes.

84. The method of claim 82, wherein the cytotoxic agent is a toxin.

85. The method of claim 84, wherein the toxin is selected from the group consisting of maytansinoid and calicheamicin.

86. The method of claim 84, wherein the toxin is a maytansinoid.

87. The method of claim 77, wherein said antibody is produced in bacteria.

88. The method of claim 77, wherein said antibody is produced in CHO cells.

89. The method of claim 77, wherein said tumor is further exposed to radiation treatment or a chemotherapeutic agent.

90. The method of claim 77, wherein said tumor is a breast tumor, a colorectal tumor, a lung tumor, an ovarian tumor, a central nervous system tumor, a liver tumor, a bladder tumor, a pancreatic tumor, or a cervical tumor.

91. The method of claim 77, wherein said protein is more abundantly expressed by the cancerous cells of said tumor as compared to a normal cell of the same tissue origin.

92. The method of claim 77, wherein said protein has:
(a) the amino acid sequence shown in any one of FIGS. 79 to 154 (SEQ ID NOS:79-154);
(b) the amino acid sequence shown in any one of FIGS. 79 to 154 (SEQ ID NOS:79-154), lacking its associated signal peptide sequence;
(c) an amino acid sequence of an extracellular domain of the polypeptide shown in any one of FIGS. 79 to 154 (SEQ ID NOS:79-154), with its associated signal peptide sequence;
(d) an amino acid sequence of an extracellular domain of the polypeptide shown in any one of FIGS. 79 to 154 (SEQ ID NOS:79-154), lacking its associated signal peptide sequence;
(e) an amino acid sequence encoded by the nucleotide sequence shown in any one of FIGS. 1 to 78A-B (SEQ ID NOS:1-78); or
(f) an amino acid sequence encoded by the full-length coding region of the nucleotide sequence shown in any one of FIGS. 1 to 78A-B (SEQ ID NOS:1-78).

93. A method of determining the presence of a protein in a sample suspected of containing said protein, wherein said protein has at least 80% amino acid sequence identity to:
(a) the polypeptide shown in any one of FIGS. 79 to 154 (SEQ ID NOS:79-154);

(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS:1-78), said method comprising exposing said sample to an antibody, oligopeptide or organic molecule that binds to said protein and determining binding of said antibody, oligopeptide or organic molecule to said protein in said sample, wherein binding of the antibody, oligopeptide or organic molecule to said protein is indicative of the presence of said protein in said sample.

94. The method of claim 93, wherein said sample comprises a cell suspected of expressing said protein.

95. The method of claim 94, wherein said cell is a cancer cell.

96. The method of claim 93, wherein said antibody, oligopeptide or organic molecule is detectably labeled.

97. The method of claim 93, wherein said protein has:

(a) the amino acid sequence shown in any one of FIGS. 79 to 154 (SEQ ID NOS:79-154);

(b) the amino acid sequence shown in any one of FIGS. 79 to 154 (SEQ ID NOS:79-154), lacking its associated signal peptide sequence;

(c) an amino acid sequence of an extracellular domain of the polypeptide shown in any one of FIGS. 79 to 154 (SEQ ID NOS:79-154), with its associated signal peptide sequence;

(d) an amino acid sequence of an extracellular domain of the polypeptide shown in any one of FIGS. 79 to 154 (SEQ ID NOS:79-154), lacking its associated signal peptide sequence;

(e) an amino acid sequence encoded by the nucleotide sequence shown in any one of FIGS. 1 to 78A-B (SEQ ID NOS:1-78); or (f) an amino acid sequence encoded by the full-length coding region of the nucleotide sequence shown in any one of FIGS. 1 to 78A-B (SEQ ID NOS:1-78).

98. A method of diagnosing the presence of a tumor in a mammal, said method comprising determining the level of expression of a gene encoding a protein having at least 80% amino acid sequence identity to:

(a) the polypeptide shown in any one of FIGS. 79 to 154 (SEQ ID NOS:79-154);

(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS:1-78), in a test sample of tissue cells obtained from said mammal and in a control sample of known normal cells of the same tissue origin, wherein a higher level of expression of said protein in the test sample, as compared to the control sample, is indicative of the presence of tumor in the mammal from which the test sample was obtained.

99. The method of claim 98, wherein the step of determining the level of expression of a gene encoding said protein comprises employing an oligonucleotide in an in situ hybridization or RT-PCR analysis.

100. The method of claim 98, wherein the step determining the level of expression of a gene encoding said protein comprises employing an antibody in an immunohistochemistry or Western blot analysis.

101. The method of claim 98, wherein said protein has:

(a) the amino acid sequence shown in any one of FIGS. 79 to 154 (SEQ ID NOS:79-154);

(b) the amino acid sequence shown in any one of FIGS. 79 to 154 (SEQ ID NOS:79-154), lacking its associated signal peptide sequence;

(c) an amino acid sequence of an extracellular domain of the polypeptide shown in any one of FIGS. 79 to 154 (SEQ ID NOS:79-154), with its associated signal peptide sequence;

(d) an amino acid sequence of an extracellular domain of the polypeptide shown in any one of FIGS. 79 to 154 (SEQ ID NOS:79-154), lacking its associated signal peptide sequence;

(e) an amino acid sequence encoded by the nucleotide sequence shown in any one of FIGS. 1 to 78A-B (SEQ ID NOS:1-78); or (f) an amino acid sequence encoded by the full-length coding region of the nucleotide sequence shown in any one of FIGS. 1 to 78A-B (SEQ ID NOS: 1-78).

102. A method of diagnosing the presence of a tumor in a mammal, said method comprising contacting a test sample of tissue cells obtained from said mammal with an antibody, oligopeptide or organic molecule that binds to a protein having at least 80% amino acid sequence identity to:

(a) the polypeptide shown in any one of FIGS. 79 to 154 (SEQ ID NOS:79-154);

(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS:1-78), and detecting the formation of a complex between said antibody, oligopeptide or organic molecule and said protein in the test sample, wherein the formation of a complex is indicative of the presence of a tumor in said mammal.

103. The method of claim 102, wherein said antibody, oligopeptide or organic molecule is detectably labeled.

104. The method of claim 102, wherein said test sample of tissue cells is obtained from an individual suspected of having a cancerous tumor.

105. The method of claim 102, wherein said protein has:

(a) the amino acid sequence shown in any one of FIGS. 79 to 154 (SEQ ID NOS:79-154);

(b) the amino acid sequence shown in any one of FIGS. 79 to 154 (SEQ ID NOS:79-154), lacking its associated signal peptide sequence;

(c) an amino acid sequence of an extracellular domain of the polypeptide shown in any one of FIGS. 79 to 154 (SEQ ID NOS:79-154), with its associated signal peptide sequence;

(d) an amino acid sequence of an extracellular domain of the polypeptide shown in any one of FIGS. 79 to 154 (SEQ ID NOS:79-154), lacking its associated signal peptide sequence;

(e) an amino acid sequence encoded by the nucleotide sequence shown in any one of FIGS. 1 to 78A-B (SEQ ID NOS:1-78); or (f) an amino acid sequence encoded by the full-length coding region of the nucleotide sequence shown in any one of FIGS. 1 to 78A-B (SEQ ID NOS: 1-78).

106. A method for treating or preventing a cell proliferative disorder associated with increased expression or activity of a protein having at least 80% amino acid sequence identity to:

(a) the polypeptide shown in any one of FIGS. 79 to 154 (SEQ ID NOS:79-154);

(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS: 1-78), said method comprising administering to a subject in need of such treatment an effective amount of an antagonist of said protein, thereby effectively treating or preventing said cell proliferative disorder.

107. The method of claim 106, wherein said cell proliferative disorder is cancer.

108. The method of claim 106, wherein said antagonist is an anti-TAT polypeptide antibody, TAT binding oligopeptide, TAT binding organic molecule or antisense oligonucleotide.

109. A method of binding an antibody, oligopeptide or organic molecule to a cell that expresses a protein having at least 80% amino acid sequence identity to:

(a) the polypeptide shown in any one of FIGS. 79 to 154 (SEQ ID NOS:79-154);

(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS:1-78), said method comprising contacting said cell with an antibody, oligopeptide or organic molecule that binds to said protein and allowing the binding of the antibody, oligopeptide or organic molecule to said protein to occur, thereby binding said antibody, oligopeptide or organic molecule to said cell.

110. The method of claim 109, wherein said antibody is a monoclonal antibody.

111. The method of claim 109, wherein said antibody is an antibody fragment.

112. The method of claim 109, wherein said antibody is a chimeric or a humanized antibody.

113. The method of claim 109, wherein said antibody, oligopeptide or organic molecule is conjugated to a growth inhibitory agent.

114. The method of claim 109, wherein said antibody, oligopeptide or organic molecule is conjugated to a cytotoxic agent.

115. The method of claim 114, wherein said cytotoxic agent is selected from the group consisting of toxins, antibiotics, radioactive isotopes and nucleolytic enzymes.

116. The method of claim 114, wherein the cytotoxic agent is a toxin.

117. The method of claim 116, wherein the toxin is selected from the group consisting of maytansinoid and calicheamicin.

118. The method of claim 116, wherein the toxin is a maytansinoid.

119. The method of claim 109, wherein said antibody is produced in bacteria.

120. The method of claim 109, wherein said antibody is produced in CHO cells.

121. The method of claim 109, wherein said cell is a cancer cell.

122. The method of claim 121, wherein said cancer cell is further exposed to radiation treatment or a chemotherapeutic agent.

123. The method of claim 121, wherein said cancer cell is selected from the group consisting of a breast cancer cell, a colorectal cancer cell, a lung cancer cell, an ovarian cancer cell, a central nervous system cancer cell, a liver cancer cell, a bladder cancer cell, a pancreatic cancer cell, a cervical cancer cell, a melanoma cell and a leukemia cell.

124. The method of claim 123, wherein said protein is more abundantly expressed by said cancer cell as compared to a normal cell of the same tissue origin.

125. The method of claim 109 which causes the death of said cell.

126. Use of a nucleic acid as claimed in any of claims 1 to 5 or 30 in the preparation of a medicament for the therapeutic treatment or diagnostic detection of a cancer.

127. Use of a nucleic acid as claimed in any of claims 1 to 5 or 30 in the preparation of a medicament for treating a tumor.

128. Use of a nucleic acid as claimed in any of claims 1 to 5 or 30 in the preparation of a medicament for treatment or prevention of a cell proliferative disorder.

129. Use of an expression vector as claimed in any of claims 6, 7 or 31 in the preparation of a medicament for the therapeutic treatment or diagnostic detection of a cancer.

130. Use of an expression vector as claimed in any of claims 6, 7 or 31 in the preparation of medicament for treating a tumor.

131. Use of an expression vector as claimed in any of claims 6, 7 or 31 in the preparation of a medicament for treatment or prevention of a cell proliferative disorder.

132. Use of a host cell as claimed in any of claims 8, 9, 32, or 33 in the preparation of a medicament for the therapeutic treatment or diagnostic detection of a cancer.

133. Use of a host cell as claimed in any of claims 8, 9, 32 or 33 in the preparation of a medicament for treating a tumor.

134. Use of a host cell as claimed in any of claims 8, 9, 32 or 33 in the preparation of a medicament for treatment or prevention of a cell proliferative disorder.

135. Use of a polypeptide as claimed in any of claims 11 to 14 in the preparation of a medicament for the therapeutic treatment or diagnostic detection of a cancer.

136. Use of a polypeptide as claimed in any of claims 11 to 14 in the preparation of a medicament for treating a tumor.

137. Use of a polypeptide as claimed in any of claims 11 to 14 in the preparation of a medicament for treatment or prevention of a cell proliferative disorder.

138. Use of an antibody as claimed in any of claims 15 to 29 in the preparation of a medicament for the therapeutic treatment or diagnostic detection of a cancer.

139. Use of an antibody as claimed in any of claims 15 to 29 in the preparation of a medicament for treating a tumor.

140. Use of an antibody as claimed in any of claims 15 to 29 in the preparation of a medicament for treatment or prevention of a cell proliferative disorder.

141. Use of an oligopeptide as claimed in any of claims 35 to 44 in the preparation of a medicament for the therapeutic treatment or diagnostic detection of a cancer.

142. Use of an oligopeptide as claimed in any of claims 35 to 44 in the preparation of a medicament for treating a tumor.

143. Use of an oligopeptide as claimed in any of claims 35 to 44 in the preparation of a medicament for treatment or prevention of a cell proliferative disorder.

144. Use of a TAT binding organic molecule as claimed in any of claims 45 to 54 in the preparation of a medicament for the therapeutic treatment or diagnostic detection of a cancer.

145. Use of a TAT binding organic molecule as claimed in any of claims 45 to 54 in the preparation of a medicament for treating a tumor.

146. Use of a TAT binding organic molecule as claimed in any of claims 45 to 54 in the preparation of a medicament for treatment or prevention of a cell proliferative disorder.

147. Use of a composition of matter as claimed in any of claims 55 or 56 in the preparation of a medicament for the therapeutic treatment or diagnostic detection of a cancer.

148. Use of a composition of matter as claimed in any of claims 55 or 56 in the preparation of a medicament for treating a tumor.

149. Use of a composition of matter as claimed in any of claims 55 or 56 in the preparation of a medicament for treatment or prevention of a cell proliferative disorder.

150. Use of an article of manufacture as claimed in any of claims 57 or 58 in the preparation of a medicament for the therapeutic treatment or diagnostic detection of a cancer.

151. Use of an article of manufacture as claimed in any of claims 57 or 58 in the preparation of a medicament for treating a tumor.

152. Use of an article of manufacture as claimed in any of claims 57 or 58 in the preparation of a medicament for treatment or prevention of a cell proliferative disorder.

153. A method for inhibiting the growth of a cell, wherein the growth of said cell is at least in part dependent upon a growth potentiating effect of a protein having at least 80% amino acid sequence identity to:
(a) the polypeptide shown in any one of FIGS. 79 to 154 (SEQ ID NOS:79-154);
(b) the polypeptide shown in any one of FIGS. 79 to 154 (SEQ ID NOS:79-154), lacking its associated signal peptide;
(c) an extracellular domain of the polypeptide shown in any one of FIGS. 79 to 154 (SEQ ID NOS:79-154), with its associated signal peptide;
(d) an extracellular domain of the polypeptide shown in any one of FIGS. 79 to 154 (SEQ ID NOS:79-154), lacking its associated signal peptide;
(e) a polypeptide encoded by the nucleotide sequence shown in any one of FIGS. 1 to 78A-B (SEQ ID NOS:1-78); or
(f) a polypeptide encoded by the full-length coding region of the nucleotide sequence shown in any one of FIGS. 1 to 78A-B (SEQ ID NOS: 1-78), said method comprising contacting said protein with an antibody, oligopeptide or organic molecule that binds to said protein, there by inhibiting the growth of said cell.

154. The method of claim 153, wherein said cell is a cancer cell.

155. The method of claim 153, wherein said protein is expressed by said cell.

156. The method of claim 153, wherein the binding of said antibody, oligopeptide or organic molecule to said protein antagonizes a cell growth-potentiating activity of said protein.

157. The method of claim 153, wherein the binding of said antibody, oligopeptide or organic molecule to said protein induces the death of said cell.

158. The method of claim 153, wherein said antibody is a monoclonal antibody.

159. The method of claim 153, wherein said antibody is an antibody fragment.

160. The method of claim 153, wherein said antibody is a chimeric or a humanized antibody.

161. The method of claim 153, wherein said antibody, oligopeptide or organic molecule is conjugated to a growth inhibitory agent.

162. The method of claim 153, wherein said antibody, oligopeptide or organic molecule is conjugated to a cytotoxic agent.

163. The method of claim 162, wherein said cytotoxic agent is selected from the group consisting of toxins, antibiotics, radioactive isotopes and nucleolytic enzymes.

164. The method of claim 162, wherein the cytotoxic agent is a toxin.

165. The method of claim 164, wherein the toxin is selected from the group consisting of maytansinoid and calicheamicin.

166. The method of claim 164, wherein the toxin is a maytansinoid.

167. The method of claim 153, wherein said antibody is produced in bacteria.

168. The method of claim 153, wherein said antibody is produced in CHO cells.

169. The method of claim 153, wherein said protein has:
(a) the amino acid sequence shown in any one of FIGS. 79 to 154 (SEQ ID NOS:79-154);
(b) the amino acid sequence shown in any one of FIGS. 79 to 154 (SEQ ID NOS:79-154), lacking its associated signal peptide sequence;
(c) an amino acid sequence of an extracellular domain of the polypeptide shown in any one of FIGS. 79 to 154 (SEQ ID NOS:79-154), with its associated signal peptide sequence;
(d) an amino acid sequence of an extracellular domain of the polypeptide shown in any one of FIGS. 79 to 154 (SEQ ID NOS:79-154), lacking its associated signal peptide sequence;
(e) an amino acid sequence encoded by the nucleotide sequence shown in any one of FIGS. 1 to 78A-B (SEQ ID NOS:1-78); or
(f) an amino acid sequence encoded by the full-length coding region of the nucleotide sequence shown in any one of FIGS. 1 to 78A-B (SEQ ID NOS: 1-78).

170. A method of therapeutically treating a tumor in a mammal, wherein the growth of said tumor is at least in part dependent upon a growth potentiating effect of a protein having at least 80% amino acid sequence identity to:
(a) the polypeptide shown in any one of FIGS. 79 to 154 (SEQ ID NOS:79-154);
(b) the polypeptide shown in any one of FIGS. 79 to 154 (SEQ ID NOS:79-154), lacking its associated signal peptide;

(c) an extracellular domain of the polypeptide shown in any one of FIGS. 79 to 154 (SEQ ID NOS:79-154), with its associated signal peptide;

(d) an extracellular domain of the polypeptide shown in any one of FIGS. 79 to 154 (SEQ ID NOS:79-154), lacking its associated signal peptide;

(e) a polypeptide encoded by the nucleotide sequence shown in any one of FIGS. 1 to 78A-B (SEQ ID NOS:1-78); or (f) a polypeptide encoded by the full-length coding region of the nucleotide sequence shown in any one of FIGS. 1 to 78A-B (SEQ ID NOS: 1-78), said method comprising contacting said protein with an antibody, oligopeptide or organic molecule that binds to said protein, thereby effectively treating said tumor.

171. The method of claim 170, wherein said protein is expressed by cells of said tumor.

172. The method of claim 170, wherein the binding of said antibody, oligopeptide or organic molecule to said protein antagonizes a cell growth-potentiating activity of said protein.

173. The method of claim 170, wherein said antibody is a monoclonal antibody.

174. The method of claim 170, wherein said antibody is an antibody fragment.

175. The method of claim 170, wherein said antibody is a chimeric or a humanized antibody.

176. The method of claim 170, wherein said antibody, oligopeptide or organic molecule is conjugated to a growth inhibitory agent.

177. The method of claim 170, wherein said antibody, oligopeptide or organic molecule is conjugated to a cytotoxic agent.

178. The method of claim 177, wherein said cytotoxic agent is selected from the group consisting of toxins, antibiotics, radioactive isotopes and nucleolytic enzymes.

179. The method of claim 177, wherein the cytotoxic agent is a toxin.

180. The method of claim 179, wherein the toxin is selected from the group consisting of maytansinoid and calicheamicin.

181. The method of claim 179, wherein the toxin is a maytansinoid.

182. The method of claim 170, wherein said antibody is produced in bacteria.

183. The method of claim 170, wherein said antibody is produced in CHO cells.

184. The method of claim 170, wherein said protein has:
(a) the amino acid sequence shown in any one of FIGS. 79 to 154 (SEQ ID NOS:79-154);
(b) the amino acid sequence shown in any one of FIGS. 79 to 154 (SEQ ID NOS:79-154), lacking its associated signal peptide sequence;
(c) an amino acid sequence of an extracellular domain of the polypeptide shown in any one of FIGS. 79 to 154 (SEQ ID NOS:79-154), with its associated signal peptide sequence;
(d) an amino acid sequence of an extracellular domain of the polypeptide shown in any one of FIGS. 79 to 154 (SEQ ID NOS:79-154), lacking its associated signal peptide sequence;
(e) an amino acid sequence encoded by the nucleotide sequence shown in any one of FIGS. 1 to 78A-B (SEQ ID NOS:1-78); or
(f) an amino acid sequence encoded by the full-length coding region of the nucleotide sequence shown in any one of FIGS. 1 to 78A-B (SEQ ID NOS: 1-78).

Yet further embodiments of the present invention will be evident to the skilled artisan upon a reading of the present specification.

BRIEF DESCRIPTION OF THE DRAWINGS

FIG. 1 shows a nucleotide sequence (SEQ ID NO:1) of a TAT161 cDNA, wherein SEQ ID NO:1 is a clone designated herein as "DNA77507".

FIGS. 2A-B show a nucleotide sequence (SEQ ID NO:2) of a TAT101 cDNA, wherein SEQ ID NO:2 is a clone designated herein as "DNA80894".

FIG. 3 shows a nucleotide sequence (SEQ ID NO:3) of a TAT157 cDNA, wherein SEQ ID NO:3 is a clone designated herein as "DNA82343".

FIG. 4 shows a nucleotide sequence (SEQ ID NO:4) of a TAT160 cDNA, wherein SEQ ID NO:4 is a clone designated herein as "DNA87994".

FIG. 5 shows a nucleotide sequence (SEQ ID NO:5) of a TAT158 cDNA, wherein SEQ ID NO:5 is a clone designated herein as "DNA88131".

FIG. 6 shows a nucleotide sequence (SEQ ID NO:6) of a TAT110 cDNA, wherein SEQ ID NO:6 is a clone designated herein as "DNA95930".

FIG. 7 shows a nucleotide sequence (SEQ ID NO:7) of a TAT210 cDNA, wherein SEQ ID NO:7 is a clone designated herein as "DNA95930-1".

FIG. 8 shows a nucleotide sequence (SEQ ID NO:8) of a TAT159 cDNA, wherein SEQ ID NO:8 is a clone designated herein as "DNA96917".

FIG. 9 shows a nucleotide sequence (SEQ ID NO:9) of a TAT112 cDNA, wherein SEQ ID NO:9 is a clone designated herein as "DNA96930".

FIG. 10 shows a nucleotide sequence (SEQ ID NO:10) of a TAT147 cDNA, wherein SEQ ID NO:10 is a clone designated herein as "DNA96936".

FIG. 11 shows a nucleotide sequence (SEQ ID NO:11) of a TAT145 cDNA, wherein SEQ ID NO:11 is a clone designated herein as "DNA98565".

FIG. 12 shows a nucleotide sequence (SEQ ID NO:12) of a TAT152 cDNA, wherein SEQ ID NO:12 is a clone designated herein as "DNA246435".

FIG. 13 shows a nucleotide sequence (SEQ ID NO:13) of a TAT162 cDNA, wherein SEQ ID NO:13 is a clone designated herein as "DNA98591".

FIG. 14 shows a nucleotide sequence (SEQ ID NO:14) of a TAT114 cDNA, wherein SEQ ID NO:14 is a clone designated herein as "DNA108809".

FIG. 15 shows a nucleotide sequence (SEQ ID NO:15) of a TAT119 cDNA, wherein SEQ ID NO:15 is a clone designated herein as "DNA119488".

FIG. 16 shows a nucleotide sequence (SEQ ID NO:16) of a TAT103 cDNA, wherein SEQ ID NO:16 is a clone designated herein as "DNA143493".

FIGS. 17A-B show a nucleotide sequence (SEQ ID NO:17) of a TAT130 cDNA, wherein SEQ ID NO:17 is a clone designated herein as "DNA 167234".

FIG. 18 shows a nucleotide sequence (SEQ ID NO:18) of a TAT166 cDNA, wherein SEQ ID NO:18 is a clone designated herein as "DNA235621".

FIG. 19 shows a nucleotide sequence (SEQ ID NO:19) of a TAT132 cDNA, wherein SEQ ID NO:19 is a clone designated herein as "DNA176766".

FIG. 20 shows a nucleotide sequence (SEQ ID NO:20) of a TAT150 cDNA, wherein SEQ ID NO:20 is a clone designated herein as "DNA236463".

FIG. 21 shows a nucleotide sequence (SEQ ID NO:21) of a TAT129 cDNA, wherein SEQ ID NO:21 is a clone designated herein as "DNA181162".

FIG. 22 shows a nucleotide sequence (SEQ ID NO:22) of a TAT111 cDNA, wherein SEQ ID NO:22 is a clone designated herein as "DNA188221".

FIG. 23 shows a nucleotide sequence (SEQ ID NO:23) of a TAT146 cDNA, wherein SEQ ID NO:23 is a clone designated herein as "DNA233876".

FIG. 24 shows a nucleotide sequence (SEQ ID NO:24) of a TAT148 cDNA, wherein SEQ ID NO:24 is a clone designated herein as "DNA193891".

FIG. 25 shows a nucleotide sequence (SEQ ID NO:25) of a TAT187 cDNA, wherein SEQ ID NO:25 is a clone designated herein as "DNA248170".

FIG. 26 shows a nucleotide sequence (SEQ ID NO:26) of a TAT118 cDNA, wherein SEQ ID NO:26 is a clone designated herein as "DNA194628".

FIG. 27 shows a nucleotide sequence (SEQ ID NO:27) of a TAT167 cDNA, wherein SEQ ID NO:27 is a clone designated herein as "DNA246415".

FIG. 28 shows a nucleotide sequence (SEQ ID NO:28) of a TAT123 cDNA, wherein SEQ ID NO:28 is a clone designated herein as "DNA210499".

FIG. 29 shows a nucleotide sequence (SEQ ID NO:29) of a TAT211 cDNA, wherein SEQ ID NO:29 is a clone designated herein as "DNA219894".

FIG. 30 shows a nucleotide sequence (SEQ ID NO:30) of a TAT113 cDNA, wherein SEQ ID NO:30 is a clone designated herein as "DNA215609".

FIG. 31 shows a nucleotide sequence (SEQ ID NO:31) of a TAT128 cDNA, wherein SEQ ID NO:31 is a clone designated herein as "DNA220432".

FIGS. 32A-B show a nucleotide sequence (SEQ ID NO:32) of a TAT164 cDNA, wherein SEQ ID NO:32 is a clone designated herein as "DNA226094".

FIG. 33 shows a nucleotide sequence (SEQ ID NO:33) of a TAT122 cDNA, wherein SEQ ID NO:33 is a clone designated herein as "DNA226165".

FIG. 34 shows a nucleotide sequence (SEQ ID NO:34) of a TAT117 cDNA, wherein SEQ ID NO:34 is a clone designated herein as "DNA226237".

FIG. 35 shows a nucleotide sequence (SEQ ID NO:35) of a TAT168 cDNA, wherein SEQ ID NO:35 is a clone designated herein as "DNA246450".

FIG. 36 shows a nucleotide sequence (SEQ ID NO:36) of a TAT144 cDNA, wherein SEQ ID NO:36 is a clone designated herein as "DNA226456".

FIG. 37 shows a nucleotide sequence (SEQ ID NO:37) of a TAT188 cDNA, wherein SEQ ID NO:37 is a clone designated herein as "DNA237637".

FIG. 38 shows a nucleotide sequence (SEQ ID NO:38) of a TAT126 cDNA, wherein SEQ ID NO:38 is a clone designated herein as "DNA226539".

FIG. 39 shows a nucleotide sequence (SEQ ID NO:39) of a TAT151 cDNA, wherein SEQ ID NO:39 is a clone designated herein as "DNA236511".

FIG. 40 shows a nucleotide sequence (SEQ ID NO:40) of a TAT115 cDNA, wherein SEQ ID NO:40 is a clone designated herein as "DNA226771".

FIG. 41 shows a nucleotide sequence (SEQ ID NO:41) of a TAT163 cDNA, wherein SEQ ID NO:41 is a clone designated herein as "DNA227087".

FIG. 42 shows a nucleotide sequence (SEQ ID NO:42) of a TAT227 cDNA, wherein SEQ ID NO:42 is a clone designated herein as "DNA266307".

FIG. 43 shows a nucleotide sequence (SEQ ID NO:43) of a TAT228 cDNA, wherein SEQ ID NO:43 is a clone designated herein as "DNA266311".

FIG. 44 shows a nucleotide sequence (SEQ ID NO:44) of a TAT229 cDNA, wherein SEQ ID NO:44 is a clone designated herein as "DNA266312".

FIG. 45 shows a nucleotide sequence (SEQ ID NO:45) of a TAT230 cDNA, wherein SEQ ID NO:45 is a clone designated herein as "DNA266313".

FIG. 46 shows a nucleotide sequence (SEQ ID NO:46) of a TAT121 cDNA, wherein SEQ ID NO:46 is a clone designated herein as "DNA227224".

FIG. 47 shows a nucleotide sequence (SEQ ID NO:47) of a TAT183 cDNA, wherein SEQ ID NO:47 is a clone designated herein as "DNA247486".

FIG. 48 shows a nucleotide sequence (SEQ ID NO:48) of a TAT165 cDNA, wherein SEQ ID NO:48 is a clone designated herein as "DNA227578".

FIG. 49 shows a nucleotide sequence (SEQ ID NO:49) of a TAT131 cDNA, wherein SEQ ID NO:49 is a clone designated herein as "DNA227800".

FIG. 50 shows a nucleotide sequence (SEQ ID NO:50) of a TAT140 cDNA, wherein SEQ ID NO:50 is a clone designated herein as "DNA227904".

FIG. 51 shows a nucleotide sequence (SEQ ID NO:51) of a TAT127 cDNA, wherein SEQ ID NO:51 is a clone designated herein as "DNA228199".

FIG. 52 shows a nucleotide sequence (SEQ ID NO:52) of a TAT116 cDNA, wherein SEQ ID NO:52 is a clone designated herein as "DNA228201".

FIG. 53 shows a nucleotide sequence (SEQ ID NO:53) of a TAT189 cDNA, wherein SEQ ID NO:53 is a clone designated herein as "DNA247488".

FIG. 54 shows a nucleotide sequence (SEQ ID NO:54) of a TAT190 cDNA, wherein SEQ ID NO:54 is a clone designated herein as "DNA236538".

FIG. 55 shows a nucleotide sequence (SEQ ID NO:55) of a TAT191 cDNA, wherein SEQ ID NO:55 is a clone designated herein as "DNA247489".

FIG. 56 shows a nucleotide sequence (SEQ ID NO:56) of a TAT133 cDNA, wherein SEQ ID NO:56 is a clone designated herein as "DNA228211".

FIG. 57 shows a nucleotide sequence (SEQ ID NO:57) of a TAT186 cDNA, wherein SEQ ID NO:57 is a clone designated herein as "DNA233937".

FIG. 58 shows a nucleotide sequence (SEQ ID NO:58) of a TAT120 cDNA, wherein SEQ ID NO:58 is a clone designated herein as "DNA228993".

FIG. 59 shows a nucleotide sequence (SEQ ID NO:59) of a TAT124 cDNA, wherein SEQ ID NO:59 is a clone designated herein as "DNA228994".

FIG. 60 shows a nucleotide sequence (SEQ ID NO:60) of a TAT105 cDNA, wherein SEQ ID NO:60 is a clone designated herein as "DNA229410".

FIGS. 61A-B show a nucleotide sequence (SEQ ID NO:61) of a TAT107 cDNA, wherein SEQ ID NO:61 is a clone designated herein as "DNA229411".

FIGS. 62A-B show a nucleotide sequence (SEQ ID NO:62) of a TAT108 cDNA, wherein SEQ ID NO:62 is a clone designated herein as "DNA229413".

FIGS. 63A-B show a nucleotide sequence (SEQ ID NO:63) of a TAT139 cDNA, wherein SEQ ID NO:63 is a clone designated herein as "DNA229700".

FIG. 64 shows a nucleotide sequence (SEQ ID NO:64) of a TAT143 cDNA, wherein SEQ ID NO:64 is a clone designated herein as "DNA231312".

FIG. 65 shows a nucleotide sequence (SEQ ID NO:65) of a TAT100 cDNA, wherein SEQ ID NO:65 is a clone designated herein as "DNA231542".

FIG. 66 shows a nucleotide sequence (SEQ ID NO:66) of a TAT284 cDNA, wherein SEQ ID NO:66 is a clone designated herein as "DNA231542-1".

FIG. 67 shows a nucleotide sequence (SEQ ID NO:67) of a TAT285 cDNA, wherein SEQ ID NO:67 is a clone designated herein as "DNA231542-2".

FIG. 68 shows a nucleotide sequence (SEQ ID NO:68) of a TAT285-1 cDNA, wherein SEQ ID NO:68 is a clone designated herein as "DNA297393".

FIG. 69 shows a nucleotide sequence (SEQ ID NO:69) of a TAT125 cDNA, wherein SEQ ID NO:69 is a clone designated herein as "DNA232754".

FIG. 70 shows a nucleotide sequence (SEQ ID NO:70) of a TAT149 cDNA, wherein SEQ ID NO:70 is a clone designated herein as "DNA234833".

FIG. 71 shows a nucleotide sequence (SEQ ID NO:71) of a TAT231 cDNA, wherein SEQ ID NO:71 is a clone designated herein as "DNA268022".

FIG. 72 shows a nucleotide sequence (SEQ ID NO:72) of a TAT153 cDNA, wherein SEQ ID NO:72 is a clone designated herein as "DNA236246".

FIG. 73 shows a nucleotide sequence (SEQ ID NO:73) of a TAT104 cDNA, wherein SEQ ID NO:73 is a clone designated herein as "DNA236343".

FIG. 74 shows a nucleotide sequence (SEQ ID NO:74) of a TAT141 cDNA, wherein SEQ ID NO:74 is a clone designated herein as "DNA236493".

FIG. 75 shows a nucleotide sequence (SEQ ID NO:75) of a TAT102 cDNA, wherein SEQ ID NO:75 is a clone designated herein as "DNA236534".

FIG. 76 shows a nucleotide sequence (SEQ ID NO:76) of a TAT109 cDNA, wherein SEQ ID NO:76 is a clone designated herein as "DNA246430".

FIG. 77 shows a nucleotide sequence (SEQ ID NO:77) of a TAT142 cDNA, wherein SEQ ID NO:77 is a clone designated herein as "DNA247480".

FIGS. 78A-B show a nucleotide sequence (SEQ ID NO:78) of a TAT106 cDNA, wherein SEQ ID NO:78 is a clone designated herein as "DNA264454".

FIG. 79 shows the amino acid sequence (SEQ ID NO:79) derived from the coding sequence of SEQ ID NO:1 shown in FIG. 1.

FIG. 80 shows the amino acid sequence (SEQ ID NO:80) derived from the coding sequence of SEQ ID NO:2 shown in FIG. 2.

FIG. 81 shows the amino acid sequence (SEQ ID NO:81) derived from the coding sequence of SEQ ID NO:3 shown in FIG. 3.

FIG. 82 shows the amino acid sequence (SEQ ID NO:82) derived from the coding sequence of SEQ ID NO:4 shown in FIG. 4.

FIG. 83 shows the amino acid sequence (SEQ ID NO:83) derived from the coding sequence of SEQ ID NO:5 shown in FIG. 5.

FIG. 84 shows the amino acid sequence (SEQ ID NO:84) derived from the coding sequence of SEQ ID NO:6 shown in FIG. 6.

FIG. 85 shows the amino acid sequence (SEQ ID NO:85) derived from the coding sequence of SEQ ID NO:7 shown in FIG. 7.

FIG. 86 shows the amino acid sequence (SEQ ID NO:86) derived from the coding sequence of SEQ ID NO:8 shown in FIG. 8.

FIG. 87 shows the amino acid sequence (SEQ ID NO:87) derived from the coding sequence of SEQ ID NO:9 shown in FIG. 9.

FIG. 88 shows the amino acid sequence (SEQ ID NO:88) derived from the coding sequence of SEQ ID NO:10 shown in FIG. 10.

FIG. 89 shows the amino acid sequence (SEQ ID NO:89) derived from the coding sequence of SEQ ID NO:11 shown in FIG. 11.

FIG. 90 shows the amino acid sequence (SEQ ID NO:90) derived from the coding sequence of SEQ ID NO:12 shown in FIG. 12.

FIG. 91 shows the amino acid sequence (SEQ ID NO:91) derived from the coding sequence of SEQ ID NO:13 shown in FIG. 13.

FIG. 92 shows the amino acid sequence (SEQ ID NO:92) derived from the coding sequence of SEQ ID NO:14 shown in FIG. 14.

FIG. 93 shows the amino acid sequence (SEQ ID NO:93) derived from the coding sequence of SEQ ID NO:15 shown in FIG. 15.

FIG. 94 shows the amino acid sequence (SEQ ID NO:94) derived from the coding sequence of SEQ ID NO:16 shown in FIG. 16.

FIG. 95 shows the amino acid sequence (SEQ ID NO:95) derived from the coding sequence of SEQ ID NO:17 shown in FIGS. 17A-B.

FIG. 96 shows the amino acid sequence (SEQ ID NO:96) derived from the coding sequence of SEQ ID NO:18 shown in FIG. 18.

FIG. 97 shows the amino acid sequence (SEQ ID NO:97) derived from the coding sequence of SEQ ID NO:19 shown in FIG. 19.

FIG. 98 shows the amino acid sequence (SEQ ID NO:98) derived from the coding sequence of SEQ ID NO:20 shown in FIG. 20.

FIG. 99 shows the amino acid sequence (SEQ ID NO:99) derived from the coding sequence of SEQ ID NO:21 shown in FIG. 21.

FIG. 100 shows the amino acid sequence (SEQ ID NO:100) derived from the coding sequence of SEQ ID NO:22 shown in FIG. 22.

FIG. 101 shows the amino acid sequence (SEQ ID NO:101) derived from the coding sequence of SEQ ID NO:23 shown in FIG. 23.

FIG. 102 shows the amino acid sequence (SEQ ID NO:102) derived from the coding sequence of SEQ ID NO:24 shown in FIG. 24.

FIG. 103 shows the amino acid sequence (SEQ ID NO:103) derived from the coding sequence of SEQ ID NO:25 shown in FIG. 25.

FIG. 104 shows the amino acid sequence (SEQ ID NO:104) derived from the coding sequence of SEQ ID NO:26 shown in FIG. 26.

FIG. 105 shows the amino acid sequence (SEQ ID NO:105) derived from the coding sequence of SEQ ID NO:27 shown in FIG. 27.

FIG. 106 shows the amino acid sequence (SEQ ID NO:106) derived from the coding sequence of SEQ ID NO:28 shown in FIG. 28.

FIG. 107 shows the amino acid sequence (SEQ ID NO:107) derived from the coding sequence of SEQ ID NO:29 shown in FIG. 29.

FIG. 108 shows the amino acid sequence (SEQ ID NO:108) derived from the coding sequence of SEQ ID NO:30 shown in FIG. 30.

FIG. 109 shows the amino acid sequence (SEQ ID NO:109) derived from the coding sequence of SEQ ID NO:31 shown in FIG. 31.

FIG. 110A-B shows the amino acid sequence (SEQ ID NO:110) derived from the coding sequence of SEQ ID NO:32 shown in FIGS. 32A-B.

FIG. 111 shows the amino acid sequence (SEQ ID NO:111) derived from the coding sequence of SEQ ID NO:33 shown in FIG. 33.

FIG. 112 shows the amino acid sequence (SEQ ID NO:112) derived from the coding sequence of SEQ ID NO:34 shown in FIG. 34.

FIG. 113 shows the amino acid sequence (SEQ ID NO:113) derived from the coding sequence of SEQ ID NO:35 shown in FIG. 35.

FIG. 114 shows the amino acid sequence (SEQ ID NO:114) derived from the coding sequence of SEQ ID NO:36 shown in FIG. 36.

FIG. 115 shows the amino acid sequence (SEQ ID NO:115) derived from the coding sequence of SEQ ID NO:37 shown in FIG. 37.

FIG. 116 shows the amino acid sequence (SEQ ID NO:116) derived from the coding sequence of SEQ ID NO:38 shown in FIG. 38.

FIG. 117 shows the amino acid sequence (SEQ ID NO:117) derived from the coding sequence of SEQ ID NO:39 shown in FIG. 39.

FIG. 118 shows the amino acid sequence (SEQ ID NO:118) derived from the coding sequence of SEQ ID NO:40 shown in FIG. 40.

FIG. 119 shows the amino acid sequence (SEQ ID NO:119) derived from the coding sequence of SEQ ID NO:41 shown in FIG. 41.

FIG. 120 shows the amino acid sequence (SEQ ID NO:120) derived from the coding sequence of SEQ ID NO:42 shown in FIG. 42.

FIG. 121 shows the amino acid sequence (SEQ ID NO:121) derived from the coding sequence of SEQ ID NO:43 shown in FIG. 43.

FIG. 122 shows the amino acid sequence (SEQ ID NO:122) derived from the coding sequence of SEQ ID NO:44 shown in FIG. 44.

FIG. 123 shows the amino acid sequence (SEQ ID NO:123) derived from the coding sequence of SEQ ID NO:45 shown in FIG. 45.

FIG. 124 shows the amino acid sequence (SEQ ID NO:124) derived from the coding sequence of SEQ ID NO:46 shown in FIG. 46.

FIG. 125 shows the amino acid sequence (SEQ ID NO:125) derived from the coding sequence of SEQ ID NO:47 shown in FIG. 47.

FIG. 126 shows the amino acid sequence (SEQ ID NO:126) derived from the coding sequence of SEQ ID NO:48 shown in FIG. 48.

FIG. 127 shows the amino acid sequence (SEQ ID NO:127) derived from the coding sequence of SEQ ID NO:49 shown in FIG. 49.

FIG. 128 shows the amino acid sequence (SEQ ID NO:128) derived from the coding sequence of SEQ ID NO:50 shown in FIG. 50.

FIG. 129 shows the amino acid sequence (SEQ ID NO:129) derived from the coding sequence of SEQ ID NO:51 shown in FIG. 51.

FIG. 130 shows the amino acid sequence (SEQ ID NO:130) derived from the coding sequence of SEQ ID NO:52 shown in FIG. 52.

FIG. 131 shows the amino acid sequence (SEQ ID NO:131) derived from the coding sequence of SEQ ID NO:53 shown in FIG. 53.

FIG. 132 shows the amino acid sequence (SEQ ID NO:132) derived from the coding sequence of SEQ ID NO:54 shown in FIG. 54.

FIG. 133 shows the amino acid sequence (SEQ ID NO:133) derived from the coding sequence of SEQ ID NO:55 shown in FIG. 55.

FIG. 134 shows the amino acid sequence (SEQ ID NO:134) derived from the coding sequence of SEQ ID NO:56 shown in FIG. 56.

FIG. 135 shows the amino acid sequence (SEQ ID NO:135) derived from the coding sequence of SEQ ID NO:57 shown in FIG. 57.

FIG. 136 shows the amino acid sequence (SEQ ID NO:136) derived from the coding sequence of SEQ ID NO:58 shown in FIG. 58.

FIG. 137 shows the amino acid sequence (SEQ ID NO:137) derived from the coding sequence of SEQ ID NO:59 shown in FIG. 59.

FIG. 138 shows the amino acid sequence (SEQ ID NO:138) derived from the coding sequence of SEQ ID NO:60 shown in FIG. 60.

FIG. 139 shows the amino acid sequence (SEQ ID NO:139) derived from the coding sequence of SEQ ID NO:61 shown in FIGS. 61A-B.

FIG. 140 shows the amino acid sequence (SEQ ID NO:140) derived from the coding sequence of SEQ ID NO:62 shown in FIGS. 62A-B.

FIG. 141 shows the amino acid sequence (SEQ ID NO:141) derived from the coding sequence of SEQ ID NO:63 shown in FIGS. 63A-B.

FIG. 142 shows the amino acid sequence (SEQ ID NO:142) derived from the coding sequence of SEQ ID NO:64 shown in FIG. 64.

FIG. 143 shows the amino acid sequence (SEQ ID NO:143) derived from the coding sequence of SEQ ID NO:66 shown in FIG. 66.

FIG. 144 shows the amino acid sequence (SEQ ID NO:144) derived from the coding sequence of SEQ ID NO:67 shown in FIG. 67.

FIG. 145 shows the amino acid sequence (SEQ ID NO:145) derived from the coding sequence of SEQ ID NO:68 shown in FIG. 68.

FIG. 146 shows the amino acid sequence (SEQ ID NO:146) derived from the coding sequence of SEQ ID NO:69 shown in FIG. 69.

FIG. 147 shows the amino acid sequence (SEQ ID NO:147) derived from the coding sequence of SEQ ID NO:70 shown in FIG. 70.

FIG. 148 shows the amino acid sequence (SEQ ID NO:148) derived from the coding sequence of SEQ ID NO:71 shown in FIG. 71.

FIG. 149 shows the amino acid sequence (SEQ ID NO:149) derived from the coding sequence of SEQ ID NO:73 shown in FIG. 73.

FIG. 150 shows the amino acid sequence (SEQ ID NO:150) derived from the coding sequence of SEQ ID NO:74 shown in FIG. 74.

FIG. 151 shows the amino acid sequence (SEQ ID NO:151) derived from the coding sequence of SEQ ID NO:75 shown in FIG. 75.

FIG. 152 shows the amino acid sequence (SEQ ID NO:152) derived from the coding sequence of SEQ ID NO:76 shown in FIG. 76.

FIG. 153 shows the amino acid sequence (SEQ ID NO:153) derived from the coding sequence of SEQ ID NO:77 shown in FIG. 77.

FIG. 154 shows the amino acid sequence (SEQ ID NO:154) derived from the coding sequence of SEQ ID NO:78 shown in FIGS. 78A-B.

DETAILED DESCRIPTION OF THE PREFERRED EMBODIMENTS

I. Definitions

The terms "TAT polypeptide" and "TAT" as used herein and when immediately followed by a numerical designation, refer to various polypeptides, wherein the complete designation (i.e., TAT/number) refers to specific polypeptide sequences as described herein. The terms "TAT/number polypeptide" and "TAT/number" wherein the term "number" is provided as an actual numerical designation as used herein encompass native sequence polypeptides, polypeptide variants and fragments of native sequence polypeptides and polypeptide variants (which are further defined herein). The TAT polypeptides described herein may be isolated from a variety of sources, such as from human tissue types or from another source, or prepared by recombinant or synthetic methods. The term "TAT polypeptide" refers to each individual TAT/number polypeptide disclosed herein. All disclosures in this specification which refer to the "TAT polypeptide" refer to each of the polypeptides individually as well as jointly. For example, descriptions of the preparation of, purification of, derivation of, formation of antibodies to or against, formation of TAT binding oligopeptides to or against, formation of TAT binding organic molecules to or against, administration of, compositions containing, treatment of a disease with, etc., pertain to each polypeptide of the invention individually. The term "TAT polypeptide" also includes variants of the TAT/number polypeptides disclosed herein.

A "native sequence TAT polypeptide" comprises a polypeptide having the same amino acid sequence as the corresponding TAT polypeptide derived from nature. Such native sequence TAT polypeptides can be isolated from nature or can be produced by recombinant or synthetic means. The term "native sequence TAT polypeptide" specifically encompasses naturally-occurring truncated or secreted forms of the specific TAT polypeptide (e.g., an extracellular domain sequence), naturally-occurring variant forms (e.g., alternatively spliced forms) and naturally-occurring allelic variants of the polypeptide. In certain embodiments of the invention, the native sequence TAT polypeptides disclosed herein are mature or full-length native sequence polypeptides comprising the full-length amino acids sequences shown in the accompanying figures. Start and stop codons (if indicated) are shown in bold font and underlined in the figures. Nucleic acid residues indicated as "N" in the accompanying figures are any nucleic acid residue. However, while the TAT polypeptides disclosed in the accompanying figures are shown to begin with methionine residues designated herein as amino acid position I in the figures, it is conceivable and possible that other methionine residues located either upstream or downstream from the amino acid position I in the figures may be employed as the starting amino acid residue for the TAT polypeptides.

The TAT polypeptide "extracellular domain" or "ECD" refers to a form of the TAT polypeptide which is essentially free of the transmembrane and cytoplasmic domains. Ordinarily, a TAT polypeptide ECD will have less than 1% of such transmembrane and/or cytoplasmic domains and preferably, will have less than 0.5% of such domains. It will be understood that any transmembrane domains identified for the TAT polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a TAT polypeptide may contain from about 5 or fewer amino acids on either side of the transmembrane domain/extracellular domain boundary as identified in the Examples or specification and such polypeptides, with or without the associated signal peptide, and nucleic acid encoding them, are contemplated by the present invention.

The approximate location of the "signal peptides" of the various TAT polypeptides disclosed herein may be shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., Prot. Eng. 10: 1-6 (1997) and von Heinje et al., Nucl. Acids. Res. 14:4683-4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention.

"TAT polypeptide variant" means a TAT polypeptide, preferably an active TAT polypeptide, as defined herein having at least about 80% amino acid sequence identity with a full-length native sequence TAT polypeptide sequence as disclosed herein, a TAT polypeptide sequence lacking the signal peptide as disclosed herein, an extracellular domain of a TAT polypeptide, with or without the signal peptide, as disclosed herein or any other fragment of a full-length TAT polypeptide sequence as disclosed herein (such as those encoded by a nucleic acid that represents only a portion of the complete coding sequence for a full-length TAT polypeptide). Such TAT polypeptide variants include, for instance, TAT polypeptides wherein one or more amino acid residues are added, or deleted, at the N- or C-terminus of the full-length native amino acid sequence. Ordinarily, a TAT polypeptide variant will have at least about 80% amino acid sequence identity, alternatively at least about 81%, 82%, 83%, 84%, 85%, 86%, 87%, 88%, 89%, 90%, 91%, 92%, 93%, 94%, 95%, 96%, 97%, 98%, or 99% amino acid sequence identity, to a full-length native sequence TAT polypeptide sequence as disclosed herein, a TAT polypeptide sequence lacking the signal peptide as disclosed herein, an extracellular domain of a TAT polypeptide, with or without the signal peptide, as disclosed herein or any other specifically defined fragment of a full-length TAT polypeptide sequence as disclosed herein. Ordinarily, TAT variant polypeptides are at least about 10 amino acids in length, alternatively at least about 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600 amino acids in length, or more. Optionally, TAT variant polypeptides will have no more than one conservative amino acid substitution as compared to the native TAT polypeptide sequence, alternatively no more than 2, 3, 4, 5, 6, 7, 8, 9, or 10 conservative amino acid substitution as compared to the native TAT polypeptide sequence.

"Percent (%) amino acid sequence identity" with respect to the TAT polypeptide sequences identified herein is defined as the percentage of amino acid residues in a candidate sequence that are identical with the amino acid residues in the specific TAT polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. For purposes herein, however, % amino acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. As examples of % amino acid sequence identity calculations using this method, Tables 2 and 3 demonstrate how to calculate the % amino acid sequence identity of the amino acid sequence designated "Comparison Protein" to the amino acid sequence designated "TAT", wherein "TAT" represents the amino acid sequence of a hypothetical TAT polypeptide of interest, "Comparison Protein" represents the amino acid sequence of a polypeptide against which the "TAT" polypeptide of interest is being compared, and "X, "Y" and "Z" each represent different hypothetical amino acid residues. Unless specifically stated otherwise, all % amino acid sequence identity values used herein are obtained as described in the immediately preceding paragraph using the ALIGN-2 computer program.

"TAT variant polynucleotide" or "TAT variant nucleic acid sequence" means a nucleic acid molecule which encodes a TAT polypeptide, preferably an active TAT polypeptide, as defined herein and which has at least about 80% nucleic acid sequence identity with a nucleotide acid sequence encoding a full-length native sequence TAT polypeptide sequence as disclosed herein, a full-length native sequence TAT polypeptide sequence lacking the signal peptide as disclosed herein, an extracellular domain of a TAT polypeptide, with or without the signal peptide, as disclosed herein or any other fragment of a full-length TAT polypeptide sequence as disclosed herein (such as those encoded by a nucleic acid that represents only a portion of the complete coding sequence for a full-length TAT polypeptide). Ordinarily, a TAT variant polynucleotide will have at least about 80% nucleic acid sequence identity, alternatively at least about 81%, 82%, 83%, 84%, 85%, 86%, 87%, 88%, 89%, 90%, 91%, 92%, 93%, 94%, 95%, 96%, 97%, 98%, or 99% nucleic acid sequence identity with a nucleic acid sequence encoding a full-length native sequence TAT polypeptide sequence as disclosed herein, a full-length native sequence TAT polypeptide sequence lacking the signal peptide as disclosed herein, an extracellular domain of a TAT polypeptide, with or without the signal sequence, as disclosed herein or any other fragment of a full-length TAT polypeptide sequence as disclosed herein. Variants do not encompass the native nucleotide sequence.

Ordinarily, TAT variant polynucleotides are at least about 5 nucleotides in length, alternatively at least about 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleotides in length, wherein in this context the term "about" means the referenced nucleotide sequence length plus or minus 10% of that referenced length.

"Percent (%) nucleic acid sequence identity" with respect to TAT-encoding nucleic acid sequences identified herein is defined as the percentage of nucleotides in a candidate sequence that are identical with the nucleotides in the TAT nucleic acid sequence of interest, after aligning the sequences and introducing gaps, if necessary, to achieve the maximum percent sequence identity. Alignment for purposes of determining percent nucleic acid sequence identity can be achieved in various ways that are within the skill in the art, for instance, using publicly available computer software such as BLAST, BLAST-2, ALIGN or Megalign (DNASTAR) software. For purposes herein, however, % nucleic acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU5 10087. The ALIGN-2 program is publicly available through Genentech, Inc., South San Francisco, Calif. or may be compiled from the source code provided in Table I below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for nucleic acid sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4 and 5, demonstrate how to calculate the % nucleic acid sequence identity of the nucleic acid sequence designated "Comparison DNA" to the nucleic acid sequence designated "TAT-DNA", wherein "TAT-DNA" represents a hypothetical TAT-encoding nucleic acid sequence of interest, "Comparison DNA" represents the nucleotide sequence of a nucleic acid molecule against which the "TAT-DNA" nucleic acid molecule of interest is being compared, and "N", "L" and "V" each represent different hypothetical nucleotides. Unless specifically stated otherwise, all % nucleic acid sequence identity values used herein are obtained as described in the immediately preceding paragraph using the ALIGN-2 computer program.

In other embodiments, TAT variant polynucleotides are nucleic acid molecules that encode a TAT polypeptide and which are capable of hybridizing, preferably under stringent hybridization and wash conditions, to nucleotide sequences encoding a full-length TAT polypeptide as disclosed herein. TAT variant polypeptides may be those that are encoded by a TAT variant polynucleotide.

The term "full-length coding region" when used in reference to a nucleic acid encoding a TAT polypeptide refers to the sequence of nucleotides which encode the full-length TAT polypeptide of the invention (which is often shown between start and stop codons, inclusive thereof, in the accompanying figures). The term "full-length coding region" when used in reference to an ATCC deposited nucleic acid refers to the TAT polypeptide-encoding portion of the cDNA that is inserted into the vector deposited with the ATCC (which is often shown between start and stop codons, inclusive thereof, in the accompanying figures). "Isolated," when used to describe the various TAT polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the TAT polypeptide natural environment will not be present. Ordinarily, however, isolated polypeptide will be prepared by at least one purification step.

An "isolated" TAT polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, may be identified by those that: (1) employ low ionic strength and high temperature for washing, for example 0.015 M sodium chloride/0.0015 M sodium citrate/ 0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) overnight hybridization in a solution that employs 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with a 10 minute wash at 42° C. in 0.2×SSC (sodium chloride/sodium citrate) followed by a 10 minute high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and %SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5× Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

The term "epitope tagged" when used herein refers to a chimeric polypeptide comprising a TAT polypeptide or anti-TAT antibody fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

"Active" or "activity" for the purposes herein refers to form(s) of a TAT polypeptide which retain a biological and/or an immunological activity of native or naturally-occurring TAT, wherein "biological" activity refers to a biological function (either inhibitory or stimulatory) caused by a native or naturally-occurring TAT other than the ability to induce the production of an antibody against an antigenic epitope possessed by a native or naturally-occurring TAT and an "immunological" activity refers to the ability to induce the production of an antibody against an antigenic epitope possessed by a native or naturally-occurring TAT.

The term "antagonist" is used in the broadest sense, and includes any molecule that partially or fully blocks, inhibits, or neutralizes a biological activity of a native TAT polypeptide disclosed herein. In a similar manner, the term "agonist" is used in the broadest sense and includes any molecule that mimics a biological activity of a native TAT polypeptide disclosed herein. Suitable agonist or antagonist molecules specifically include agonist or antagonist antibodies or antibody fragments, fragments or amino acid sequence variants of native TAT polypeptides, peptides, antisense oligonucleotides, small organic molecules, etc. Methods for identifying agonists or antagonists of a TAT polypeptide may comprise contacting a TAT polypeptide with a candidate agonist or antagonist molecule and measuring a detectable change in one or more biological activities normally associated with the TAT polypeptide.

"Treating" or "treatment" or "alleviation" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented. A subject or mammal is successfully "treated" for a TAT polypeptide-expressing cancer if, after receiving a therapeutic amount of an anti-TAT antibody, TAT binding oligopeptide or TAT binding organic molecule according to the methods of the present invention, the patient shows observable and/or measurable reduction in or absence of one or more of the following: reduction in the number of cancer cells or absence of the cancer cells; reduction in the tumor size; inhibition (i.e., slow to some extent and preferably stop) of cancer cell infiltration into peripheral organs including the spread of cancer into soft tissue and bone; inhibition (i.e., slow to some extent and preferably stop) of tumor metastasis; inhibition, to some extent, of tumor growth; and/or relief to some extent, one or more of the symptoms associated with the specific cancer; reduced morbidity and mortality, and improvement in quality of life issues. To the extent the anti-TAT antibody or TAT binding oligopeptide may prevent growth and/or kill existing cancer cells, it may be cytostatic and/or cytotoxic. Reduction of these signs or symptoms may also be felt by the patient.

The above parameters for assessing successful treatment and improvement in the disease are readily measurable by routine procedures familiar to a physician. For cancer therapy, efficacy can be measured, for example, by assessing the time to disease progression (TTP) and/or determining the response rate (RR). Metastasis can be determined by staging tests and by bone scan and tests for calcium level and other enzymes to determine spread to the bone. CT scans can also be done to look for spread to the pelvis and lymph nodes in the area. Chest X-rays and measurement of liver enzyme levels by known methods are used to look for metastasis to the lungs and liver, respectively. Other routine methods for monitoring the disease include transrectal ultrasonography (TRUS) and transrectal needle biopsy (TRNB).

For bladder cancer, which is a more localized cancer, methods to determine progress of disease include urinary cytologic evaluation by cystoscopy, monitoring for presence of blood in the urine, visualization of the urothelial tract by sonography or an intravenous pyelogram, computed tomography (CT) and magnetic resonance imaging (MRI). The presence of distant metastases can be assessed by CT of the abdomen, chest x-rays, or radionuclide imaging of the skeleton.

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

"Mammal" for purposes of the treatment of, alleviating the symptoms of or diagnosis of a cancer refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN®, polyethylene glycol (PEG), and PLURONICS®.

By "solid phase" or "solid support" is meant a non-aqueous matrix to which an antibody, TAT binding oligopeptide or TAT binding organic molecule of the present invention can adhere or attach. Examples of solid phases encompassed herein include those formed partially or entirely of glass (e.g., controlled pore glass), polysaccharides (e.g., agarose), polyacrylamides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat. No. 4,275,149.

A "liposome" is a small vesicle composed of various types of lipids, phospholipids and/or surfactant which is useful for delivery of a drug (such as a TAT polypeptide, an antibody thereto or a TAT binding oligopeptide) to a mammal. The components of the liposome are commonly arranged in a bilayer formation, similar to the lipid arrangement of biological membranes.

A "small" molecule or "small" organic molecule is defined herein to have a molecular weight below about 500 Daltons.

An "effective amount" of a polypeptide, antibody, TAT binding oligopeptide, TAT binding organic molecule or an agonist or antagonist thereof as disclosed herein is an amount sufficient to carry out a specifically stated purpose. An "effective amount" may be determined empirically and in a routine manner, in relation to the stated purpose.

The term "therapeutically effective amount" refers to an amount of an antibody, polypeptide, TAT binding oligopeptide, TAT binding organic molecule or other drug effective to "treat" a disease or disorder in a subject or mammal. In the case of cancer, the therapeutically effective amount of the drug may reduce the number of cancer cells; reduce the tumor size; inhibit (i.e., slow to some extent and preferably stop) cancer cell infiltration into peripheral organs; inhibit (i.e., slow to some extent and preferably stop) tumor metastasis; inhibit, to some extent, tumor growth; and/or relieve to some extent one or more of the symptoms associated with the cancer. See the definition herein of "treating". To the extent the drug may prevent growth and/or kill existing cancer cells, it may be cytostatic and/or cytotoxic.

A "growth inhibitory amount" of an anti-TAT antibody, TAT polypeptide, TAT binding oligopeptide or TAT binding organic molecule is an amount capable of inhibiting the growth of a cell, especially tumor, e.g., cancer cell, either in vitro or in vivo. A "growth inhibitory amount" of an anti-TAT antibody, TAT polypeptide, TAT binding oligopeptide or TAT binding organic molecule for purposes of inhibiting neoplastic cell growth may be determined empirically and in a routine manner.

A "cytotoxic amount" of an anti-TAT antibody, TAT polypeptide, TAT binding oligopeptide or TAT binding organic molecule is an amount capable of causing the destruction of a cell, especially tumor, e.g., cancer cell, either in vitro or in vivo. A "cytotoxic amount" of an anti-TAT antibody, TAT polypeptide, TAT binding oligopeptide or TAT binding organic molecule for purposes of inhibiting neoplastic cell growth may be determined empirically and in a routine manner.

The term "antibody" is used in the broadest sense and specifically covers, for example, single anti-TAT monoclonal antibodies (including agonist, antagonist, and neutralizing antibodies), anti-TAT antibody compositions with polyepitopic specificity, polyclonal antibodies, single chain anti-TAT antibodies, and fragments of anti-TAT antibodies (see below) as long as they exhibit the desired biological or immunological activity. The term "immunoglobulin" (Ig) is used interchangeable with antibody herein.

An "isolated antibody" is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The basic 4-chain antibody unit is a heterotetrameric glycoprotein composed of two identical light (L) chains and two identical heavy (H) chains (an IgM antibody consists of 5 of the basic heterotetramer unit along with an additional polypeptide called J chain, and therefore contain 10 antigen binding sites, while secreted IgA antibodies can polymerize to form polyvalent assemblages comprising 2-5 of the basic 4-chain units along with J chain). In the case of IgGs, the 4-chain unit is generally about 150,000 daltons. Each L chain is linked to a H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable domain ($V_H$) followed by three constant domains ($C_H$) for each of the α and γ chains and four $C_H$ domains for μ and ε isotypes. Each L chain has at the N-terminus, a variable domain ($V_L$) followed by a constant domain ($C_L$) at its other end. The $V_L$ is aligned with the $V_H$ and the $C_L$ is aligned with the first constant domain of the heavy chain ($C_H1$). Particular amino acid residues are believed to form an interface between the light chain and heavy chain variable domains. The pairing of a $V_H$ and $V_L$ together forms a single antigen-binding site. For the structure and properties of the different classes of antibodies, see, e.g., *Basic and Clinical Immunology*, 8th edition, Daniel P. Stites, Abba I. Terr and Tristram G. Parslow (eds.), Appleton & Lange, Norwalk, Conn., 1994, page 71 and Chapter 6.

The L chain from any vertebrate species can be assigned to one of two clearly distinct types, called kappa and lambda, based on the amino acid sequences of their constant domains. Depending on the amino acid sequence of the constant domain of their heavy chains ($C_H$), immunoglobulins can be assigned to different classes or isotypes. There are five classes of immunoglobulins: IgA, IgD, IgE, IgG, and IgM, having heavy chains designated α, δ, ε, γ, and μ, respectively. The γ and α classes are further divided into subclasses on the basis of relatively minor differences in $C_H$ sequence and function, e.g., humans express the following subclasses: IgG1, IgG2, IgG3, IgG4, IgA1, and IgA2.

The term "variable" refers to the fact that certain segments of the variable domains differ extensively in sequence among antibodies. The V domain mediates antigen binding and define specificity of a particular antibody for its particular antigen. However, the variability is not evenly distributed across the 110-amino acid span of the variable domains. Instead, the V regions consist of relatively invariant stretches called framework regions (FRs) of 15-30 amino acids separated by shorter regions of extreme variability called "hypervariable regions" that are each 9-12 amino acids long. The variable domains of native heavy and light chains each comprise four FRs, largely adopting a β-sheet configuration, connected by three hypervariable regions, which form loops connecting, and in some cases forming part of, the β-sheet structure. The hypervariable regions in each chain are held together in close proximity by the FRs and, with the hypervariable regions from the other chain, contribute to the formation of the antigen-binding site of antibodies (see Kabat et al., *Sequences of Proteins of Immunological Interest*, 5th Ed. Public Health Service, National Institutes of Health, Bethesda, Md. (1991)). The constant domains are not involved directly in binding an antibody to an antigen, but exhibit various effector functions, such as participation of the antibody in antibody dependent cellular cytotoxicity (ADCC).

The term "hypervariable region" when used herein refers to the amino acid residues of an antibody which are responsible for antigen-binding. The hypervariable region generally comprises amino acid residues from a "complementarity determining region" or "CDR" (e.g. around about residues 24-34 (L1), 50-56 (L2) and 89-97 (L3) in the $V_L$, and around about 1-35 (H1), 50-65 (H2) and 95-102 (H3) in the $V_H$; Kabat et al., *Sequences of Proteins of Immunological Interest*, 5th Ed. Public Health Service, National Institutes of Health, Bethesda, Md. (1991)) and/or those residues from a "hypervariable loop" (e.g. residues 26-32 (L1), 50-52 (L2) and 91-96 (L3) in the $V_L$, and 26-32 (H1), 53-55 (H2) and 96-101 (H3) in the $V_H$; Chothia and Lesk *J. Mol. Biol.* 196:901-917 (1987)).

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to polyclonal antibody preparations which include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" is not to be construed as requiring production of the antibody by any particular method. For example, the monoclonal antibodies useful in the present invention may be prepared by the hybridoma methodology first described by Kohler et al., *Nature*, 256:495 (1975), or may be made using recombinant DNA methods in bacterial, eukaryotic animal or plant cells (see, e.g., U.S. Pat. No. 4,816, 567). The "monoclonal antibodies" may also be isolated from phage antibody libraries using the techniques described in Clackson et al., *Nature*, 352:624-628 (1991) and Marks et al., *J. Mol. Biol.*, 222:581-597 (1991), for example.

The monoclonal antibodies herein include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see U.S. Pat. No. 4,816,567; and Morrison et al., *Proc. Natl. Acad. Sci. USA*, 81:6851-6855 (1984)). Chimeric antibodies of interest herein include "primatized" antibodies comprising variable domain antigen-binding sequences derived from a non-human primate ( e.g. Old World Monkey, Ape etc), and human constant region sequences.

An "intact" antibody is one which comprises an antigen-binding site as well as a $C_L$ and at least heavy chain constant domains, $C_H1$, $C_H2$ and $C_H3$. The constant domains may be native sequence constant domains (eg. human native sequence constant domains) or amino acid sequence variant thereof. Preferably, the intact antibody has one or more effector functions.

"Antibody fragments" comprise a portion of an intact antibody, preferably the antigen binding or variable region of the intact antibody. Examples of antibody fragments include Fab, Fab', F(ab')$_2$, and Fv fragments; diabodies; linear antibodies (see U.S. Pat. No. 5,641,870, Example 2; Zapata et al., *Protein Eng.* 8(10): 1057-1062 [1995]); single-chain antibody molecules; and multispecific antibodies formed from antibody fragments.

Papain digestion of antibodies produces two identical antigen-binding fragments, called "Fab" fragments, and a residual "Fc" fragment, a designation reflecting the ability to crystallize readily. The Fab fragment consists of an entire L chain along with the variable region domain of the H chain ($V_H$), and the first constant domain of one heavy chain ($C_H1$). Each Fab fragment is monovalent with respect to antigen binding, i.e., it has a single antigen-binding site. Pepsin treatment of an antibody yields a single large F(ab')$_2$ fragment which roughly corresponds to two disulfide linked Fab fragments having divalent antigen-binding activity and is still capable of cross-linking antigen. Fab' fragments differ from Fab fragments by having additional few residues at the carboxy terminus of the $C_H1$ domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The Fc fragment comprises the carboxy-terminal portions of both H chains held together by disulfides. The effector functions of antibodies are determined by sequences in the Fc region, which region is also the part recognized by Fc receptors (FcR) found on certain types of cells.

"Fv" is the minimum antibody fragment which contains a complete antigen-recognition and -binding site. This fragment consists of a dimer of one heavy- and one light-chain variable region domain in tight, non-covalent association. From the folding of these two domains emanate six hypervariable loops (3 loops each from the H and L chain) that contribute the amino acid residues for antigen binding and confer antigen binding specificity to the antibody. However, even a single variable domain (or half of an Fv comprising only three CDRs specific for an antigen) has the ability to recognize and bind antigen, although at a lower affinity than the entire binding site.

"Single-chain Fv" also abbreviated as "sFv" or "scFv" are antibody fragments that comprise the $V_H$ and $V_L$ antibody domains connected into a single polypeptide chain. Preferably, the sFv polypeptide further comprises a polypeptide linker between the $V_H$ and $V_L$ domains which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269-315 (1994); Borrebaeck 1995, infra.

The term "diabodies" refers to small antibody fragments prepared by constructing sFv fragments (see preceding paragraph) with short linkers (about 5-10 residues) between the $V_H$ and $V_L$ domains such that inter-chain but not intra-chain pairing of the V domains is achieved, resulting in a bivalent fragment, i.e., fragment having two antigen-binding sites. Bispecific diabodies are heterodimers of two "crossover" sFv fragments in which the $V_H$ and $V_L$ domains of the two antibodies are present on different polypeptide chains. Diabodies are described more fully in, forexample, EP404, 097; WO 93/11161; and Hollinger et al., Proc. Natl. Acad. Sci. USA, 90:6444-6448 (1993).

"Humanized" forms of non-human (e.g., rodent) antibodies are chimeric antibodies that contain minimal sequence derived from the non-human antibody. For the most part, humanized antibodies are human immunoglobulins (recipient antibody) in which residues from a hypervariable region of the recipient are replaced by residues from a hypervariable region of a non-human species (donor antibody) such as mouse, rat, rabbit or non-human primate having the desired antibody specificity, affinity, and capability. In some instances, framework region (FR) residues of the human immunoglobulin are replaced by corresponding non-human residues. Furthermore, humanized antibodies may comprise residues that are not found in the recipient antibody or in the donor antibody. These modifications are made to further refine antibody performance. In general, the humanized antibody will comprise substantially all of at least one, and typically two, variable domains, in which all or substantially all of the hypervariable loops correspond to those of a non-human immunoglobulin and all or substantially all of the FRs are those of a human immunoglobulin sequence. The humanized antibody optionally also will comprise at least a portion of an immunoglobulin constant region (Fc), typically that of a human immunoglobulin. For further details, see Jones et al., *Nature* 321:522-525 (1986); Riechmann et al., *Nature* 332: 323-329 (1988); and Presta, *Curr. Op. Struct. Biol.* 2:593-596 (1992).

A "species-dependent antibody," e.g., a mammalian anti-human IgE antibody, is an antibody which has a stronger binding affinity for an antigen from a first mammalian species than it has for a homologue of that antigen from a second mammalian species. Normally, the species-dependent antibody "bind specifically" to a human antigen (i.e., has a binding affinity (Kd) value of no more than about $1 \times 10^{-7}$ M, preferably no more than about $1 \times 10^{-8}$ and most preferably no more than about $1 \times 10^{-9}$ M) but has a binding affinity for a homologue of the antigen from a second non-human mammalian species which is at least about 50 fold, or at least about 500 fold, or at least about 1000 fold, weaker than its binding affinity for the human antigen. The species-dependent antibody can be of any of the various types of antibodies as defined above, but preferably is a humanized or human antibody.

A "TAT binding oligopeptide" is an oligopeptide that binds, preferably specifically, to a TAT polypeptide as described herein. TAT binding oligopeptides may be chemically synthesized using known oligopeptide synthesis methodology or may be prepared and purified using recombinant technology. TAT binding oligopeptides are usually at least about 5 amino acids in length, alternatively at least about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 amino acids in length or more, wherein such oligopeptides that are capable of binding, preferably specifically, to a TAT polypeptide as described herein. TAT binding oligopeptides may be identified without undue experimentation using well known techniques. In this regard, it is noted that techniques for screening oligopeptide libraries for oligopeptides that are capable of specifically binding to a polypeptide target are well known in the art (see, e.g., U.S. Pat. Nos. 5,556,762, 5,750,373, 4,708,871, 4,833, 092, 5,223,409, 5,403,484, 5,571,689, 5,663,143; PCT Publication Nos. WO 84/03506 and WO84/03564; Geysen et al., Proc. Natl. Acad. Sci. U.S.A., 81:3998-4002 (1984); Geysen et al., Proc. Natl. Acad. Sci. U.S.A., 82:178-182 (1985); Geysen et al., in Synthetic Peptides as Antigens, 130-149 (1986); Geysen et al., J. Immunol. Meth., 102:259-274 (1987); Schoofs et al., J. Immunol. 140:611-616 (1988), Cwirla, S. E. et al. (1990) Proc. Natl. Acad. Sci. USA, 87:6378; Lowman, H. B. et al. (1991) Biochemistry, 30:10832; Clackson, T. et al. (1991) Nature, 352: 624; Marks, J. D. et al. (1991), J. Mol. Biol., 222:581; Kang, A. S. et al. (1991) Proc. Natl. Acad. Sci. USA, 88:8363, and Smith, G. P. (1991) Current Opin. Biotechnol., 2:668).

A "TAT binding organic molecule" is an organic molecule other than an oligopeptide or antibody as defined herein that binds, preferably specifically, to a TAT polypeptide as described herein. TAT binding organic molecules may be identified and chemically synthesized using known methodology (see, e.g., PCT Publication Nos. WO00/00823 and WO00/39585). TAT binding organic molecules are usually less than about 2000 daltons in size, alternatively less than about 1500, 750, 500, 250 or 200 daltons in size, wherein such organic molecules that are capable of binding, preferably specifically, to a TAT polypeptide as described herein may be identified without undue experimentation using well known techniques. In this regard, it is noted that techniques for screening organic molecule libraries for molecules that are capable of binding to a polypeptide target are well known in the art (see, e.g., PCT Publication Nos. WO00/00823 and WO00/39585).

An antibody, oligopeptide or other organic molecule "which binds" an antigen of interest, e.g. a tumor-associated polypeptide antigen target, is one that binds the antigen with sufficient affinity such that the antibody, oligopeptide or other organic molecule is useful as a diagnostic and/or therapeutic agent in targeting a cell or tissue expressing the antigen, and does not significantly cross-react with other proteins. In such embodiments, the extent of binding of the antibody, oligopeptide or other organic molecule to a "non-target" protein will be less than about 10% of the binding of the antibody, oligopeptide or other organic molecule to its particular target protein as determined by fluorescence activated cell sorting (FACS) analysis or radioimmunoprecipitation (RIA). With regard to the binding of an antibody, oligopeptide or other organic molecule to a target molecule, the term "specific binding" or "specifically binds to" or is "specific for" a particular polypeptide or an epitope on a particular polypeptide target means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target, for example, an excess of non-labeled target. In this case, specific binding is indicated if the binding of the labeled target to a probe is competitively inhibited by excess unlabeled target. The term "specific binding" or "specifically binds to" or is "specific for" a particular polypeptide or an epitope on a particular polypeptide target as used herein can be exhibited, for example, by a molecule having a Kd for the target of at least about $10^{-4}$ M, alternatively at least about $10^{-5}$ M, alternatively at least about $10^{-6}$ M, alternatively at least about $10^{-7}$ M, alternatively at least about $10^{-8}$ M, alternatively at least about $10^{-9}$ M, alternatively at least about $10^{-10}$ M, alternatively at least about $10^{-11}$ M, alternatively at least about $10^{-12}$ M, or greater. In one embodiment, the term "specific binding" refers to binding where a molecule binds to a particular polypeptide or epitope on a particular polypeptide without substantially binding to any other polypeptide or polypeptide epitope.

An antibody, oligopeptide or other organic molecule that "inhibits the growth of tumor cells expressing a TAT polypeptide" or a "growth inhibitory" antibody, oligopeptide or other organic molecule is one which results in measurable growth inhibition of cancer cells expressing or overexpressing the appropriate TAT polypeptide. The TAT polypeptide may be a transmembrane polypeptide expressed on the surface of a cancer cell or may be a polypeptide that is produced and secreted by a cancer cell. Preferred growth inhibitory anti-TAT antibodies, oligopeptides or organic molecules inhibit growth of TAT-expressing tumor cells by greater than 20%, preferably from about 20% to about 50%, and even more preferably, by greater than 50% (e.g., from about 50% to about 100%) as compared to the appropriate control, the control typically being tumor cells not treated with the antibody, oligopeptide or other organic molecule being tested. In one embodiment, growth inhibition can be measured at an antibody concentration of about 0.1 to 30 μg/ml or about 0.5 nM to 200 nM in cell culture, where the growth inhibition is determined 1-10 days after exposure of the tumor cells to the antibody. Growth inhibition of tumor cells in vivo can be determined in various ways such as is described in the Experimental Examples section below. The antibody is growth inhibitory in vivo if administration of the anti-TAT antibody at about 1 μg/kg to about 100 mg/kg body weight results in reduction in tumor size or tumor cell proliferation within about 5 days to 3 months from the first administration of the antibody, preferably within about 5 to 30 days.

An antibody, oligopeptide or other organic molecule which "induces apoptosis" is one which induces programmed cell death as determined by binding of annexin V, fragmentation of DNA, cell shrinkage, dilation of endoplasmic reticulum, cell fragmentation, and/or formation of membrane vesicles (called apoptotic bodies). The cell is usually one which overexpresses a TAT polypeptide. Preferably the cell is a tumor cell, e.g., a prostate, breast, ovarian, stomach, endometrial, lung, kidney, colon, bladder cell. Various methods are available for evaluating the cellular events associated with apoptosis. For example, phosphatidyl serine (PS) translocation can be measured by annexin binding; DNA fragmentation can be evaluated through DNA laddering; and nuclear/chromatin condensation along with DNA fragmentation can be evaluated by any increase in hypodiploid cells. Preferably, the antibody, oligopeptide or other organic molecule which induces apoptosis is one which results in about 2 to 50 fold, preferably about 5 to 50 fold, and most preferably about 10 to 50 fold, induction of annexin binding relative to untreated cell in an annexin binding assay.

Antibody "effector functions" refer to those biological activities attributable to the Fc region (a native sequence Fc region or amino acid sequence variant Fc region) of an antibody, and vary with the antibody isotype. Examples of antibody effector functions include: C1q binding and complement dependent cytotoxicity; Fc receptor binding; antibody-dependent cell-mediated cytotoxicity (ADCC); phagocytosis; down regulation of cell surface receptors (e.g., B cell receptor); and B cell activation.

"Antibody-dependent cell-mediated cytotoxicity" or "ADCC" refers to a form of cytotoxicity in which secreted Ig bound onto Fc receptors (FcRs) present on certain cytotoxic cells (e.g., Natural Killer (NK) cells, neutrophils, and macrophages) enable these cytotoxic effector cells to bind specifically to an antigen-bearing target cell and subsequently kill the target cell with cytotoxins. The antibodies "arm" the cytotoxic cells and are absolutely required for such killing. The primary cells for mediating ADCC, NK cells, express Fc γRIII only, whereas monocytes express FcγRI, FcγRII and FcγRIII. FcR expression on hematopoietic cells is summarized in Table 3 on page 464 of Ravetch and Kinet, *Annu. Rev. Immunol.* 9:457-92 (1991). To assess ADCC activity of a molecule of interest, an in vitro ADCC assay, such as that described in U.S. Pat. No. 5,500,362 or 5,821,337 may be performed. Useful effector cells for such assays include peripheral blood mononuclear cells (PBMC) and Natural Killer (NK) cells. Alternatively, or additionally, ADCC activity of the molecule of interest may be assessed in vivo, e.g., in a animal model such as that disclosed in Clynes et al. (USA) 95:652-656 (1998).

"Fc receptor" or "FcR" describes a receptor that binds to the Fc region of an antibody. The preferred FcR is a native sequence human FcR. Moreover, a preferred FcR is one which binds an IgG antibody (a gamma receptor) and includes receptors of the FcγRI, FcγRII and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. Activating receptor FγRIA contains an immunoreceptor tyrosine-based activation motif(ITAM) in its cytoplasmic domain. Inhibiting receptor FγRIIB contains an immunoreceptor tyrosine-based inhibition motif (ITIM) in its cytoplasmic domain. (see review M. in Daëron, *Annu. Rev. Immunol.* 15:203-234 (1997)). FcRs are reviewed in Ravetch and Kinet, *Annu. Rev. Immunol.* 9:457-492 (1991); Capel et al., *Immunomethods* 4:25-34 (1994); and de Haas et al., *J. Lab. Clin. Med.* 126: 330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al., *J. Immunol.* 117:587 (1976) and Kim et al., *J. Immunol.* 24:249 (1994)).

"Human effector cells" are leukocytes which express one or more FcRs and perform effector functions. Preferably, the cells express at least FcγRIII and perform ADCC effector function. Examples of human leukocytes which mediate ADCC include peripheral blood mononuclear cells (PBMC), natural killer (NK) cells, monocytes, cytotoxic T cells and neutrophils; with PBMCs and NK cells being preferred. The effector cells may be isolated from a native source, e.g., from blood.

"Complement dependent cytotoxicity" or "CDC" refers to the lysis of a target cell in the presence of complement. Activation of the classical complement pathway is initiated by the binding of the first component of the complement system (C1q) to antibodies (of the appropriate subclass) which are bound to their cognate antigen. To assess complement activation, a CDC assay, e.g., as described in Gazzano-Santoro et al., *Immunol. Methods* 202:163 (1996), may be performed.

The terms "cancer" and "cancerous" refer to or describe the physiological condition in mammals that is typically characterized by unregulated cell growth. Examples of cancer include, but are not limited to, carcinoma, lymphoma, blastoma, sarcoma, and leukemia or lymphoid malignancies. More particular examples of such cancers include squamous cell cancer (e.g., epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer, pancreatic cancer, glioblastoma, cervical cancer, ovarian cancer, liver cancer, bladder cancer, cancer of the urinary tract, hepatoma, breast cancer, colon cancer, rectal cancer, colorectal cancer, endometrial or uterine carcinoma, salivary gland carcinoma, kidney or renal cancer, prostate cancer, vulval cancer, thyroid cancer, hepatic carcinoma, anal carcinoma, penile carcinoma, melanoma, multiple myeloma and B-cell lymphoma, brain, as well as head and neck cancer, and associated metastases.

The terms "cell proliferative disorder" and "proliferative disorder" refer to disorders that are associated with some degree of abnormal cell proliferation. In one embodiment, the cell proliferative disorder is cancer. "Tumor", as used herein, refers to all neoplastic cell growth and proliferation, whether malignant or benign, and all pre-cancerous and cancerous cells and tissues.

An antibody, oligopeptide or other organic molecule which "induces cell death" is one which causes a viable cell to become nonviable. The cell is one which expresses a TAT polypeptide, preferably a cell that overexpresses a TAT polypeptide as compared to a normal cell of the same tissue type. The TAT polypeptide may be a transmembrane polypeptide expressed on the surface of a cancer cell or may be a polypeptide that is produced and secreted by a cancer cell. Preferably, the cell is a cancer cell, e.g., a breast, ovarian, stomach, endometrial, salivary gland, lung, kidney, colon, thyroid, pancreatic or bladder cell. Cell death in vitro may be determined in the absence of complement and immune effector cells to distinguish cell death induced by antibody-dependent cell-mediated cytotoxicity (ADCC) or complement dependent cytotoxicity (CDC). Thus, the assay for cell death may be performed using heat inactivated serum (i.e., in the absence of complement) and in the absence of immune effector cells. To determine whether the antibody, oligopeptide or other organic molecule is able to induce cell death, loss of membrane integrity as evaluated by uptake of propidium iodide (PI), trypan blue (see Moore et al. *Cytotechnology* 17:1-11 (1995)) or 7AAD can be assessed relative to untreated cells. Preferred cell death-inducing antibodies, oligopeptides or other organic molecules are those which induce PI uptake in the PI uptake assay in BT474 cells.

A "TAT-expressing cell" is a cell which expresses an endogenous or transfected TAT polypeptide either on the cell surface or in a secreted form. A "TAT-expressing cancer" is a cancer comprising cells that have a TAT polypeptide present on the cell surface or that produce and secrete a TAT polypeptide. A "TAT-expressing cancer" optionally produces sufficient levels of TAT polypeptide on the surface of cells thereof, such that an anti-TAT antibody, oligopeptide other organic molecule can bind thereto and have a therapeutic effect with respect to the cancer. In another embodiment, a "TAT-expressing cancer" optionally produces and secretes sufficient levels of TAT polypeptide, such that an anti-TAT antibody, oligopeptide to other organic molecule antagonist can bind thereto and have a therapeutic effect with respect to the cancer. With regard to the latter, the antagonist may be an antisense oligonucleotide which reduces, inhibits or prevents production and secretion of the secreted TAT polypeptide by tumor cells. A cancer which "overexpresses" a TAT polypeptide is one which has significantly higher levels of TAT polypeptide at the cell surface thereof, or produces and secretes, compared to a noncancerous cell of the same tissue type. Such overexpression may be caused by gene amplification or by increased transcription or translation. TAT polypeptide overexpression may be determined in a diagnostic or prognostic assay by evaluating increased levels of the TAT protein present on the surface of a cell, or secreted by the cell (e.g., via an immunohistochemistry assay using anti-TAT antibodies prepared against an isolated TAT polypeptide which may be prepared using recombinant DNA technology from an isolated nucleic acid encoding the TAT polypeptide; FACS analysis, etc.). Alternatively, or additionally, one may measure levels of TAT polypeptide-encoding nucleic acid or mRNA in the cell, e.g., via fluorescent in situ hybridization using a nucleic acid based probe corresponding to a TAT-encoding nucleic acid or the complement thereof; (FISH; see WO98/45479 published October, 1998), Southern blotting, Northern blotting, or polymerase chain reaction (PCR) techniques, such as real time quantitative PCR (RT-PCR). One may also study TAT polypeptide overexpression by measuring shed antigen in a biological fluid such as serum, e.g., using antibody-based assays (see also, e.g., U.S. Pat. No. 4,933,294 issued Jun. 12, 1990; WO91/05264 published Apr. 18, 1991; U.S. Pat. No. 5,401,638 issued Mar. 28, 1995; and Sias et al., *J. Immunol. Methods* 132:73-80(1990)). Aside from the above assays, various in vivo assays are available to the skilled practitioner. For example, one may expose cells within the body of the patient to an antibody which is optionally labeled with a detectable label, e.g., a radioactive isotope, and binding of the antibody to cells in the patient can be evaluated, e.g., by external scanning for radioactivity or by analyzing a biopsy taken from a patient previously exposed to the antibody.

As used herein, the term "immunoadhesin" designates antibody-like molecules which combine the binding specificity of a heterologous protein (an "adhesin") with the effector functions of immunoglobulin constant domains. Structurally, the immunoadhesins comprise a fusion of an amino acid sequence with the desired binding specificity which is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG-4 subtypes, IgA (including IgA-1 and IgA-2), IgE, IgD or IgM.

The word "label" when used herein refers to a detectable compound or composition which is conjugated directly or indirectly to the antibody, oligopeptide or other organic molecule so as to generate a "labeled" antibody, oligopeptide or other organic molecule. The label may be detectable by itself (e.g. radioisotope labels or fluorescent labels) or, in the case of an enzymatic label, may catalyze chemical alteration of a substrate compound or composition which is detectable.

The term "cytotoxic agent" as used herein refers to a substance that inhibits or prevents the function of cells and/or causes destruction of cells. The term is intended to include radioactive isotopes (e.g., $At^{211}$, $I^{131}$, $I^{125}$, $Y^{90}$, $Re^{186}$, $Re^{188}$, $Sm^{153}$, $Bi^{212}$, $P^{32}$ and radioactive isotopes of Lu), chemotherapeutic agents e.g. methotrexate, adriamicin, vinca alkaloids (vincristine, vinblastine, etoposide), doxorubicin, melphalan, mitomycin C, chlorambucil, daunorubicin or other intercalating agents, enzymes and fragments thereof such as nucleolytic enzymes, antibiotics, and toxins such as small molecule toxins or enzymatically active toxins of bacterial, fungal, plant or animal origin, including fragments and/or variants thereof, and the various antitumor or anticancer agents disclosed below. Other cytotoxic agents are described below. A tumoricidal agent causes destruction of tumor cells.

A "growth inhibitory agent" when used herein refers to a compound or composition which inhibits growth of a cell, especially a TAT-expressing cancer cell, either in vitro or in vivo. Thus, the growth inhibitory agent may be one which significantly reduces the percentage of TAT-expressing cells in S phase. Examples of growth inhibitory agents include agents that block cell cycle progression (at a place other than S phase), such as agents that induce G1 arrest and M-phase arrest. Classical M-phase blockers include the vincas (vincristine and vinblastine), taxanes, and topoisomerase II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in *The Molecular Basis of Cancer*, Mendelsohn and Israel, eds., Chapter 1, entitled "Cell cycle regulation, oncogenes, and antineoplastic drugs" by Murakami et al. (W B Saunders: Philadelphia, 1995), especially p. 13. The taxanes (paclitaxel and docetaxel) are anticancer drugs both derived from the yew tree. Docetaxel (TAXOTERE®, Rhone-Poulenc Rorer), derived from the European yew, is a semisynthetic analogue of paclitaxel (TAXOL®, Bristol-Myers Squibb). Paclitaxel and docetaxel promote the assembly of microtubules from tubulin dimers and stabilize microtubules by preventing depolymerization, which results in the inhibition of mitosis in cells.

"Doxorubicin" is an anthracycline antibiotic. The full chemical name of doxorubicin is (8S-cis)-10-[(3-amino-2,3, 6-trideoxy-α-L-lyxo-hexapyranosyl)oxy]-7,8,9,10-tetrahydro-6,8,11-trihydroxy-8-(hydroxyacetyl)-1-methoxy-5,12-naphthacenedione.

The term "cytokine" is a generic term for proteins released by one cell population which act on another cell as intercellular mediators. Examples of such cytokines are lymphokines, monokines, and traditional polypeptide hormones. Included among the cytokines are growth hormone such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor α and -β; mullerian-inhibiting substance; mouse gonadotropin-associated peptide; inhibin; activin; vascular endothelial growth factor; integrin; thrombopoietin (TPO); nerve growth factors such as NGF-β; platelet-growth factor; transforming growth factors (TGFs) such as TGF-α and TGF-β; insulin-like growth factor-I and -II; erythropoietin (EPO); osteoinductive factors; interferons such as interferon -α, -β, and -γ; colony stimulating factors (CSFs) such as macrophage-CSF (M-CSF); granulocyte-macrophage-CSF (GM-CSF); and granulocyte-CSF (G-CSF); interleukins (ILs) such as IL-1, IL-1a, IL-2, IL-3, IL-4, IL-5, IL-6, IL-7, IL-8, IL-9, IL-11, IL-12; a tumor necrosis factor such as TNF-α or TNF-β; and other polypeptide factors including LIF and kit ligand (KL). As used herein, the term cytokine includes proteins from natural sources or from recombinant cell culture and biologically active equivalents of the native sequence cytokines.

The term "package insert" is used to refer to instructions customarily included in commercial packages of therapeutic products, that contain information about the indications, usage, dosage, administration, contraindications and/or warnings concerning the use of such therapeutic products.

Table 1

```
/*
 *
 * C-C increased from 12 to 15
 * Z is average of EQ
 * B is average of ND
 * match with stop is _M; stop-stop = 0; J (joker) match = 0
 */
define   _M      -8         /* value of a match with a stop */ int      _day[26][26] = {
/*       A  B  C  D  E  F  G  H  I  J  K  L  M  N  O  P  Q  R  S  T  U  V  W  X  Y  Z */
/* A */ { 2, 0,-2, 0, 0,-4, 1,-1,-1, 0,-1,-2,-1, 0,_M, 1, 0,-2, 1, 1, 0, 0,-6, 0,-3, 0},
/* B */ { 0, 3,-4, 3, 2,-5, 0, 1,-2, 0, 0,-3,-2, 2,_M,-1, 1, 0, 0, 0, 0,-2,-5, 0,-3, 1},
/* C */ {-2,-4,15,-5,-5,-4,-3,-3,-2, 0,-5,-6,-5,-4,_M,-3,-5,-4, 0,-2, 0,-2,-8, 0, 0,-5},
/* D */ { 0, 3,-5, 4, 3,-6, 1, 1,-2, 0, 0,-4,-3, 2,_M,-1, 2,-1, 0, 0, 0,-2,-7, 0,-4, 2},
/* E */ { 0, 2,-5, 3, 4,-5, 0, 1,-2, 0, 0,-3,-2, 1,_M,-1, 2,-1, 0, 0, 0,-2,-7, 0,-4, 3},
/* F */ {-4,-5,-4,-6,-5, 9,-5,-2, 1, 0,-5, 2, 0,-4,_M,-5,-5,-4,-3,-3, 0,-1, 0, 0, 7,-5},
/* G */ { 1, 0,-3, 1, 0,-5, 5,-2,-3, 0,-2,-4,-3, 0,_M,-1,-1,-3, 1, 0, 0,-1,-7, 0,-5, 0},
/* H */ {-1, 1,-3, 1, 1,-2,-2, 6,-2, 0, 0,-2,-2, 2,_M, 0, 3, 2,-1,-1, 0,-2,-3, 0, 0, 2},
/* I */ {-1,-2,-2,-2,-2, 1,-3,-2, 5, 0,-2, 2, 2,-2,_M,-2,-2,-2,-1, 0, 0, 4,-5, 0,-1,-2},
/* J */ { 0, 0, 0, 0, 0, 0, 0, 0, 0, 0, 0, 0, 0, 0,_M, 0, 0, 0, 0, 0, 0, 0, 0, 0, 0, 0},
/* K */ {-1, 0,-5, 0, 0,-5,-2, 0,-2, 0, 5,-3, 0, 1,_M,-1, 1, 3, 0, 0, 0,-2,-3, 0,-4, 0},
/* L */ {-2,-3,-6,-4,-3, 2,-4,-2, 2, 0,-3, 6, 4,-3,_M,-3,-2,-3,-3,-1, 0, 2,-2, 0,-1,-2},
/* M */ {-1,-2,-5,-3,-2, 0,-3,-2, 2, 0, 0, 4, 6,-2,_M,-2,-1, 0,-2,-1, 0, 2,-4, 0,-2,-1},
/* N */ { 0, 2,-4, 2, 1,-4, 0, 2,-2, 0, 1,-3,-2, 2,_M,-1, 1, 0, 1, 0, 0,-2,-4, 0,-2, 1},
/* O */ {_M,_M,_M,_M,_M,_M,_M,_M,_M,_M,_M,_M,_M,_M, 0,_M,_M,_M,_M,_M,_M,_M,_M,_M,_M,_M},
/* P */ { 1,-1,-3,-1,-1,-5,-1, 0,-2, 0,-1,-3,-2,-1,_M, 6, 0, 0, 1, 0, 0,-1,-6, 0,-5, 0},
/* Q */ { 0, 1,-5, 2, 2,-5,-1, 3,-2, 0, 1,-2,-1, 1,_M, 0, 4, 1,-1,-1, 0,-2,-5, 0,-4, 3},
/* R */ {-2, 0,-4,-1,-1,-4,-3, 2,-2, 0, 3,-3, 0, 0,_M, 0, 1, 6, 0,-1, 0,-2, 2, 0,-4, 0},
/* S */ { 1, 0, 0, 0, 0,-3, 1,-1,-1, 0, 0,-3,-2, 1,_M, 1,-1, 0, 2, 1, 0,-1,-2, 0,-3, 0},
/* T */ { 1, 0,-2, 0, 0,-3, 0,-1, 0, 0, 0,-1,-1, 0,_M, 0,-1,-1, 1, 3, 0, 0,-5, 0,-3, 0},
/* U */ { 0, 0, 0, 0, 0, 0, 0, 0, 0, 0, 0, 0, 0, 0,_M, 0, 0, 0, 0, 0, 0, 0, 0, 0, 0, 0},
/* V */ { 0,-2,-2,-2,-2,-1,-1,-2, 4, 0,-2, 2, 2,-2,_M,-1,-2,-2,-1, 0, 0, 4,-6, 0,-2,-2},
/* W */ {-6,-5,-8,-7,-7, 0,-7,-3,-5, 0,-3,-2,-4,-4,_M,-6,-5, 2,-2,-5, 0,-6,17, 0, 0,-6},
/* X */ { 0, 0, 0, 0, 0, 0, 0, 0, 0, 0, 0, 0, 0, 0,_M, 0, 0, 0, 0, 0, 0, 0, 0, 0, 0, 0},
/* Y */ {-3,-3, 0,-4,-4, 7,-5, 0,-1, 0,-4,-1,-2,-2,_M,-5,-4,-4,-3,-3, 0,-2, 0, 0,10,-4},
/* Z */ { 0, 1,-5, 2, 3,-5, 0, 2,-2, 0, 0,-2,-1, 1,_M, 0, 3, 0, 0, 0, 0,-2,-6, 0,-4, 4}
};
```

Table 1 (cont')

```
/*
*/
#include <stdio.h>
include <ctype.h> define  MAXJMP   16     /* max jumps in a diag */
define  MAXGAP   24     /* don't continue to penalize gaps larger than this */
#define  JMPS     1024   /* max jmps in an path */
define  MX       4      /* save if there's at least MX-1 bases since last jmp */ define  DMAT     3      /* value of matching bases */
define  DMIS     0      /* penalty for mismatched bases */
#define  DINS0    8      /* penalty for a gap */
#define  DINS1    1      /* penalty per base */
#define  PINS0    8      /* penalty for a gap */
define  PINS1    4      /* penalty per residue */ struct jmp {
         short           n[MAXJMP];      /* size of jmp (neg for dely) */
         unsigned short  x[MAXJMP];      /* base no. of jmp in seq x */
                                         /* limits seq to 2^16 -1 */
};

struct diag {
         int          score;      /* score at last jmp */
         long         offset;     /* offset of prev block */
         short        ijmp;       /* current jmp index */
         struct jmp   jp;         /* list of jmps */
};

struct path {
         int     spc;          /* number of leading spaces */
         short   n[JMPS];      /* size of jmp (gap) */
         int     x[JMPS];      /* loc of jmp (last elem before gap) */
};

char      *ofile;              /* output file name */
char      *namex[2];           /* seq names: getseqs() */
char      *prog;               /* prog name for err msgs */
char      *seqx[2];            /* seqs: getseqs() */
int       dmax;                /* best diag: nw() */
int       dmax0;               /* final diag */
int       dna;                 /* set if dna: main() */
int       endgaps;             /* set if penalizing end gaps */
int       gapx, gapy;          /* total gaps in seqs */
int       len0, len1;          /* seq lens */
int       ngapx, ngapy;        /* total size of gaps */
int       smax;                /* max score: nw() */
int       *xbm;                /* bitmap for matching */
long      offset;              /* current offset in jmp file */
struct    diag  *dx;           /* holds diagonals */
struct    path  pp[2];         /* holds path for seqs */ char      *calloc(), *malloc(), *index(), *strcpy();
char      *getseq(), *g_calloc();
```

Table 1 (cont')

```
/* Needleman-Wunsch alignment program
 *
 * usage: progs file1 file2
 * where file1 and file2 are two dna or two protein sequences.
 * The sequences can be in upper- or lower-case an may contain ambiguity
 * Any lines beginning with ';', '>' or '<' are ignored
 * Max file length is 65535 (limited by unsigned short x in the jmp struct)
 * A sequence with 1/3 or more of its elements ACGTU is assumed to be DNA
 * Output is in the file "align.out"
 *
 * The program may create a tmp file in /tmp to hold info about traceback.
 * Original version developed under BSD 4.3 on a vax 8650
 */
include "nw.h"
#include "day.h"

static   _dbval[26] = {
         1,14,2,13,0,0,4,11,0,0,12,0,3,15,0,0,0,5,6,8,8,7,9,0,10,0
};

static   _pbval[26] = {
         1, 2|(1<<('D'-'A'))|(1<<('N'-'A')), 4, 8, 16, 32, 64,
         128, 256, 0xFFFFFFFF, 1<<10, 1<<11, 1<<12, 1<<13, 1<<14,
         1<<15, 1<<16, 1<<17, 1<<18, 1<<19, 1<<20, 1<<21, 1<<22,
         1<<23, 1<<24, 1<<25|(1<<('E'-'A'))|(1<<('Q'-'A'))
};

main(ac, av)                                                              main
         int     ac;
         char    *av[];
{
         prog = av[0];
         if (ac != 3) {
                 fprintf(stderr,"usage: %s file1 file2\n", prog);
                 fprintf(stderr,"where file1 and file2 are two dna or two protein sequences.\n");
                 fprintf(stderr,"The sequences can be in upper- or lower-case\n");
                 fprintf(stderr,"Any lines beginning with ';' or '<' are ignored\n");
                 fprintf(stderr,"Output is in the file \"align.out\"\n");
                 exit(1);
         }
         namex[0] = av[1];
         namex[1] = av[2];
         seqx[0] = getseq(namex[0], &len0);
         seqx[1] = getseq(namex[1], &len1);
         xbm = (dna)? _dbval : _pbval;

endgaps = 0;              /* 1 to penalize endgaps */
         ofile = "align.out";      /* output file */ nw();                     /* fill in the matrix, get the possible jmps */
         readjmps();               /* get the actual jmps */
         print();                  /* print stats, alignment */ cleanup(0);               /* unlink any tmp files */
}
```

Table 1 (cont')

```
/* do the alignment, return best score: main()
 * dna: values in Fitch and Smith, PNAS, 80, 1382-1386, 1983
 * pro: PAM 250 values
 * When scores are equal, we prefer mismatches to any gap, prefer
 * a new gap to extending an ongoing gap, and prefer a gap in seqx
 * to a gap in seq y.
 */
nw()                                                                                    nw
{
        char        *px, *py;           /* seqs and ptrs */
        int         *ndely, *dely;      /* keep track of dely */
        int         ndelx, delx;        /* keep track of delx */
        int         *tmp;               /* for swapping row0, row1 */
        int         mis;                /* score for each type */
        int         ins0, ins1;         /* insertion penalties */
        register    id;                 /* diagonal index */
        register    ij;                 /* jmp index */
        register    *col0, *col1;       /* score for curr, last row */
        register    xx, yy;             /* index into seqs */ dx = (struct diag *)g_calloc("to get diags", len0+len1+1, sizeof(struct diag));

ndely = (int *)g_calloc("to get ndely", len1+1, sizeof(int));
        dely = (int *)g_calloc("to get dely", len1+1, sizeof(int));
        col0 = (int *)g_calloc("to get col0", len1+1, sizeof(int));
        col1 = (int *)g_calloc("to get col1", len1+1, sizeof(int));
        ins0 = (dna)? DINS0 : PINS0;
        ins1 = (dna)? DINS1 : PINS1;

smax = -10000;
        if (endgaps) {
                for (col0[0] = dely[0] = -ins0, yy = 1; yy <= len1; yy++) {
                        col0[yy] = dely[yy] = col0[yy-1] - ins1;
                        ndely[yy] = yy;
                }
                col0[0] = 0;            /* Waterman Bull Math Biol 84 */
        }
        else
                for (yy = 1; yy <= len1; yy++)
                        dely[yy] = -ins0;

/* fill in match matrix
         */
        for (px = seqx[0], xx = 1; xx <= len0; px++, xx++) {
                /* initialize first entry in col
                 */
                if (endgaps) {
                        if (xx == 1)
                                col1[0] = delx = -(ins0+ins1);
                        else
                                col1[0] = delx = col0[0] - ins1;
                        ndelx = xx;
                }
                else {
                        col1[0] = 0;
                        delx = -ins0;
                        ndelx = 0;
                }
```

Table 1 (cont')

...nw

```
for (py = seqx[1], yy = 1; yy <= len1; py++, yy++) {
        mis = col0[yy-1];
        if (dna)
                mis += (xbm[*px-'A']&xbm[*py-'A'])? DMAT : DMIS;
        else
                mis += _day[*px-'A'][*py-'A'];

/* update penalty for del in x seq;
         * favor new del over ongong del
         * ignore MAXGAP if weighting endgaps
         */
        if (endgaps || ndely[yy] < MAXGAP) {
                if (col0[yy] - ins0 >= dely[yy]) {
                        dely[yy] = col0[yy] - (ins0+ins1);
                        ndely[yy] = 1;
                } else {
                        dely[yy] -= ins1;
                        ndely[yy]++;
                }
        } else {
                if (col0[yy] - (ins0+ins1) >= dely[yy]) {
                        dely[yy] = col0[yy] - (ins0+ins1);
                        ndely[yy] = 1;
                } else
                        ndely[yy]++;
        }

/* update penalty for del in y seq;
         * favor new del over ongong del
         */
        if (endgaps || ndelx < MAXGAP) {
                if (col1[yy-1] - ins0 >= delx) {
                        delx = col1[yy-1] - (ins0+ins1);
                        ndelx = 1;
                } else {
                        delx -= ins1;
                        ndelx++;
                }
        } else {
                if (col1[yy-1] - (ins0+ins1) >= delx) {
                        delx = col1[yy-1] - (ins0+ins1);
                        ndelx = 1;
                } else
                        ndelx++;
        }

/* pick the maximum score; we're favoring
         * mis over any del and delx over dely
         */
```

Table 1 (cont')

...nw

```
                    id = xx - yy + len1 - 1;
                    if (mis >= delx && mis >= dely[yy])
                            col1[yy] = mis;
                    else if (delx >= dely[yy]) {
                            col1[yy] = delx;
                            ij = dx[id].ijmp;
                            if (dx[id].jp.n[0] && (!dna || (ndelx >= MAXJMP
                                && xx > dx[id].jp.x[ij]+MX) || mis > dx[id].score+DINS0)) {
                                    dx[id].ijmp++;
                                    if (++ij >= MAXJMP) {
                                            writejmps(id);
                                            ij = dx[id].ijmp = 0;
                                            dx[id].offset = offset;
                                            offset += sizeof(struct jmp) + sizeof(offset);
                                    }
                            }
                            dx[id].jp.n[ij] = ndelx;
                            dx[id].jp.x[ij] = xx;
                            dx[id].score = delx;
                    }
                    else {
                            col1[yy] = dely[yy];
                            ij = dx[id].ijmp;
        if (dx[id].jp.n[0] && (!dna || (ndely[yy] >= MAXJMP
                                && xx > dx[id].jp.x[ij]+MX) || mis > dx[id].score+DINS0)) {
                                    dx[id].ijmp++;
                                    if (++ij >= MAXJMP) {
                                            writejmps(id);
                                            ij = dx[id].ijmp = 0;
                                            dx[id].offset = offset;
                                            offset += sizeof(struct jmp) + sizeof(offset);
                                    }
                            }
                            dx[id].jp.n[ij] = -ndely[yy];
                            dx[id].jp.x[ij] = xx;
                            dx[id].score = dely[yy];
                    }
                    if (xx == len0 && yy < len1) {
                            /* last col
                             */
                            if (endgaps)
                                    col1[yy] -= ins0+ins1*(len1-yy);
                            if (col1[yy] > smax) {
                                    smax = col1[yy];
                                    dmax = id;
                            }
                    }
            }
            if (endgaps && xx < len0)
                    col1[yy-1] -= ins0+ins1*(len0-xx);
            if (col1[yy-1] > smax) {
                    smax = col1[yy-1];
                    dmax = id;
            }
            tmp = col0; col0 = col1; col1 = tmp;
    }
    (void) free((char *)ndely);
    (void) free((char *)dely);
    (void) free((char *)col0);
    (void) free((char *)col1);                          }
```

Table 1 (cont')

```
/*
 *
 * print() -- only routine visible outside this module
 *
 * static:
 * getmat() -- trace back best path, count matches: print()
 * pr_align() -- print alignment of described in array p[]: print()
 * dumpblock() -- dump a block of lines with numbers, stars: pr_align()
 * nums() -- put out a number line: dumpblock()
 * putline() -- put out a line (name, [num], seq, [num]): dumpblock()
 * stars() - -put a line of stars: dumpblock()
 * stripname() -- strip any path and prefix from a seqname
 */ include "nw.h"

define SPC      3
#define P_LINE   256      /* maximum output line */
define P_SPC    3        /* space between name or num and seq */ extern   _day[26][26];
int      olen;            /* set output line length */
FILE     *fx;             /* output file */ print()
{
        int     lx, ly, firstgap, lastgap;      /* overlap */ if ((fx = fopen(ofile, "w")) == 0) {
                fprintf(stderr,"%s: can't write %s\n", prog, ofile);
                cleanup(1);
        }
        fprintf(fx, "<first sequence: %s (length = %d)\n", namex[0], len0);
        fprintf(fx, "<second sequence: %s (length = %d)\n", namex[1], len1);
        olen = 60;
        lx = len0;
        ly = len1;
        firstgap = lastgap = 0;
        if (dmax < len1 - 1) {           /* leading gap in x */
                pp[0].spc = firstgap = len1 - dmax - 1;
                ly -= pp[0].spc;
        }
        else if (dmax > len1 - 1) {      /* leading gap in y */
                pp[1].spc = firstgap = dmax - (len1 - 1);
                lx -= pp[1].spc;
        }
        if (dmax0 < len0 - 1) {          /* trailing gap in x */
                lastgap = len0 - dmax0 -1;
                lx -= lastgap;
        }
        else if (dmax0 > len0 - 1) {     /* trailing gap in y */
                lastgap = dmax0 - (len0 - 1);
                ly -= lastgap;
        }
        getmat(lx, ly, firstgap, lastgap);
        pr_align();
}
``` print

Table 1 (cont')

```
/*
 * trace back the best path, count matches
 */
static
getmat(lx, ly, firstgap, lastgap)                                                      getmat
        int       lx, ly;                  /* "core" (minus endgaps) */
        int       firstgap, lastgap;       /* leading trailing overlap */
{
        int              nm, i0, i1, siz0, siz1;
        char             outx[32];
        double           pct;
        register         n0, n1;
        register char    *p0, *p1;

/* get total matches, score
         */
        i0 = i1 = siz0 = siz1 = 0;
        p0 = seqx[0] + pp[1].spc;
        p1 = seqx[1] + pp[0].spc;
        n0 = pp[1].spc + 1;
        n1 = pp[0].spc + 1;

nm = 0;
        while ( *p0 && *p1 ) {
                if (siz0) {
                        p1++;
                        n1++;
                        siz0--;
                }
                else if (siz1) {
                        p0++;
                        n0++;
                        siz1--;
                }
                else {
                        if (xbm[*p0-'A']&xbm[*p1-'A'])
                                nm++;
                        if (n0++ == pp[0].x[i0])
                                siz0 = pp[0].n[i0++];
                        if (n1++ == pp[1].x[i1])
                                siz1 = pp[1].n[i1++];
                        p0++;
                        p1++;
                }
        }

/* pct homology:
         * if penalizing endgaps, base is the shorter seq
         * else, knock off overhangs and take shorter core
         */
        if (endgaps)
                lx = (len0 < len1)? len0 : len1;
        else
                lx = (lx < ly)? lx : ly;
        pct = 100.*(double)nm/(double)lx;
        fprintf(fx, "\n");
        fprintf(fx, "<%d match%s in an overlap of %d: %.2f percent similarity\n",
                nm, (nm == 1)? "" : "es", lx, pct);
```

Table 1 (cont')

```
                                                                          ...getmat
        fprintf(fx, "<gaps in first sequence: %d", gapx);
        if (gapx) {
                (void) sprintf(outx, " (%d %s%s)",
                        ngapx, (dna)? "base":"residue", (ngapx == 1)? "":"s");
                fprintf(fx,"%s", outx);

fprintf(fx, ", gaps in second sequence: %d", gapy);
        if (gapy) {
                (void) sprintf(outx, " (%d %s%s)",
                        ngapy, (dna)? "base":"residue", (ngapy == 1)? "":"s");
                fprintf(fx,"%s", outx);
        }
        if (dna)
                fprintf(fx,
                "\n<score: %d (match = %d, mismatch = %d, gap penalty = %d + %d per base)\n",
                smax, DMAT, DMIS, DINS0, DINS1);
        else
                fprintf(fx,
                "\n<score: %d (Dayhoff PAM 250 matrix, gap penalty = %d + %d per residue)\n",
                smax, PINS0, PINS1);
        if (endgaps)
                fprintf(fx,
                "<endgaps penalized. left endgap: %d %s%s, right endgap: %d %s%s\n",
                firstgap, (dna)? "base" : "residue", (firstgap == 1)? "" : "s",
                lastgap, (dna)? "base" : "residue", (lastgap == 1)? "" : "s");
        else
                fprintf(fx, "<endgaps not penalized\n");
} static          nm;             /* matches in core -- for checking */
static          lmax;           /* lengths of stripped file names */
static          ij[2];          /* jmp index for a path */
static          nc[2];          /* number at start of current line */
static          ni[2];          /* current elem number -- for gapping */
static          siz[2];
static char     *ps[2];         /* ptr to current element */
static char     *po[2];         /* ptr to next output char slot */
static char     out[2][P_LINE]; /* output line */
static char     star[P_LINE];   /* set by stars() */

/*
 * print alignment of described in struct path pp[]
 */
static
pr_align()                                                                pr_align
{
        int     nn;     /* char count */
        int     more;
        register i;

for (i = 0, lmax = 0; i < 2; i++) {
                nn = stripname(namex[i]);
                if (nn > lmax)
                        lmax = nn;

nc[i] = 1;
                ni[i] = 1;
                siz[i] = ij[i] = 0;
                ps[i] = seqx[i];
                po[i] = out[i];                         }
```

Table 1 (cont')

```
for (nn = nm = 0, more = 1; more; ) {                                    ...pr_align
        for (i = more = 0; i < 2; i++) {
                /*
                 * do we have more of this sequence?
                 */
                if (!*ps[i])
                        continue;

more++;

if (pp[i].spc) {        /* leading space */
                        *po[i]++ = ' ';
                        pp[i].spc--;
                }
                else if (siz[i]) {      /* in a gap */
                        *po[i]++ = '-';
                        siz[i]--;
                }
                else {                  /* we're putting a seq element
                                         */
                        *po[i] = *ps[i];
                        if (islower(*ps[i]))
                                *ps[i] = toupper(*ps[i]);
                        po[i]++;
                        ps[i]++;

/*
                         * are we at next gap for this seq?
                         */
                        if (ni[i] == pp[i].x[ij[i]]) {
                                /*
                                 * we need to merge all gaps
                                 * at this location
                                 */
                                siz[i] = pp[i].n[ij[i]++];
                                while (ni[i] == pp[i].x[ij[i]])
                                        siz[i] += pp[i].n[ij[i]++];
                        }
                        ni[i]++;
                }
        }
        if (++nn == olen || !more && nn) {
                dumpblock();
                for (i = 0; i < 2; i++)
                        po[i] = out[i];
                nn = 0;
        }
    }
}
/*
 * dump a block of lines, including numbers, stars: pr_align()
 */
static
dumpblock()                                                              dumpblock
{
        register i;

for (i = 0; i < 2; i++)
                *po[i]-- = '\0';
```

Table 1 (cont')

...dumpblock

```
            (void) putc('\n', fx);
            for (i = 0; i < 2; i++) {
                    if (*out[i] && (*out[i] != ' ' || *(po[i]) != ' ')) {
                            if (i == 0)
                                    nums(i);
                            if (i == 0 && *out[1])
                                    stars();
                            putline(i);
                            if (i == 0 && *out[1])
                                    fprintf(fx, star);
                            if (i == 1)
                                    nums(i);
                    }
            }
    }

/*
    * put out a number line: dumpblock()
    */
    static
    nums(ix)
            int        ix;         /* index in out[] holding seq line */
    {
            char       nline[P_LINE];
            register   i, j;
            register char  *pn, *px, *py;

for (pn = nline, i = 0; i < lmax+P_SPC; i++, pn++)
                    *pn = ' ';
            for (i = nc[ix], py = out[ix]; *py; py++, pn++) {
                    if (*py == ' ' || *py == '-')
                            *pn = ' ';
                    else {
                            if (i%10 == 0 || (i == 1 && nc[ix] != 1)) {
                                    j = (i < 0)? -i : i;
                                    for (px = pn; j; j /= 10, px--)
                                            *px = j%10 + '0';
                                    if (i < 0)
                                            *px = '-';
                            }
                            else
                                    *pn = ' ';
                            i++;
                    }
            }
            *pn = '\0';
            nc[ix] = i;
            for (pn = nline; *pn; pn++)
                    (void) putc(*pn, fx);
            (void) putc('\n', fx);
    }
``` nums

```
    /*
    * put out a line (name, [num], seq, [num]): dumpblock()
    */
    static
    putline(ix)
            int        ix;                      {
``` putline

Table 1 (cont')

...putline

```
        int             i;
        register char   *px;

for (px = namex[ix], i = 0; *px && *px != ':'; px++, i++)
                (void) putc(*px, fx);
        for (; i < lmax+P_SPC; i++)
                (void) putc(' ', fx);

/* these count from 1:
         * ni[] is current element (from 1)
         * nc[] is number at start of current line
         */
        for (px = out[ix]; *px; px++)
                (void) putc(*px&0x7F, fx);
        (void) putc('\n', fx);
}

/*
 * put a line of stars (seqs always in out[0], out[1]): dumpblock()
 */
static
stars()
{
        int             i;
        register char   *p0, *p1, cx, *px;

if (!*out[0] || (*out[0] == ' ' && *(po[0]) == ' ') ||
            !*out[1] || (*out[1] == ' ' && *(po[1]) == ' '))
                return;
        px = star;
        for (i = lmax+P_SPC; i; i--)
                *px++ = ' ';

for (p0 = out[0], p1 = out[1]; *p0 && *p1; p0++, p1++) {
                if (isalpha(*p0) && isalpha(*p1)) { if (xbm[*p0-'A']&xbm[*p1-'A']) {
                                cx = '*';
                                nm++;
                        }
                        else if (!dna && _day[*p0-'A'][*p1-'A'] > 0)
                                cx = '.';
                        else
                                cx = ' ';
                }
                else
                        cx = ' ';
                *px++ = cx;
        }
        *px++ = '\n';
        *px = '\0';
}
``` stars

Table 1 (cont')

```
/*
 * strip path or prefix from pn, return len: pr_align()
 */
static
stripname(pn)
        char    *pn;    /* file name (may be path) */
{
        register char   *px, *py;

py = 0;
        for (px = pn; *px; px++)
                if (*px == '/')
                        py = px + 1;
        if (py)
                (void) strcpy(pn, py);
        return(strlen(pn));

}
``` stripname

Table 1 (cont')

```
/*
 * cleanup() -- cleanup any tmp file
 * getseq() -- read in seq, set dna, len, maxlen
 * g_calloc() -- calloc() with error checkin
 * readjmps() -- get the good jmps, from tmp file if necessary
 * writejmps() -- write a filled array of jmps to a tmp file: nw()
 */
include "nw.h"
include <sys/file.h> char        *jname = "/tmp/homgXXXXXX";        /* tmp file for jmps */
FILE        *fj;

int         cleanup();                          /* cleanup tmp file */
long        lseek();

/*
 * remove any tmp file if we blow
 */
cleanup(i)                                                                      cleanup
        int     i;
{
        if (fj)
                (void) unlink(jname);
        exit(i);
}

/*
 * read, return ptr to seq, set dna, len, maxlen
 * skip lines starting with ';', '<', or '>'
 * seq in upper or lower case
 */
char    *
getseq(file, len)                                                               getseq
        char        *file;     /* file name */
        int         *len;      /* seq len */
{
        char            line[1024], *pseq;
        register char   *px, *py;
        int             natgc, tlen;
        FILE            *fp;

if ((fp = fopen(file,"r")) == 0) {
                fprintf(stderr,"%s: can't read %s\n", prog, file);
                exit(1);
        }
        tlen = natgc = 0;
        while (fgets(line, 1024, fp)) {
                if (*line == ';' || *line == '<' || *line == '>')
                        continue;
                for (px = line; *px != '\n'; px++)
                        if (isupper(*px) || islower(*px))
                                tlen++;
        }
        if ((pseq = malloc((unsigned)(tlen+6))) == 0) {
                fprintf(stderr,"%s: malloc() failed to get %d bytes for %s\n", prog, tlen+6, file);
                exit(1);
        }
        pseq[0] = pseq[1] = pseq[2] = pseq[3] = '\0';
```

Table 1 (cont')

...getseq

```
            py = pseq + 4;
            *len = tlen;
            rewind(fp);

while (fgets(line, 1024, fp)) {
                      if (*line == ';' || *line == '<' || *line == '>')
                                continue;
                      for (px = line; *px != '\n'; px++) {
                                if (isupper(*px))
                                          *py++ = *px;
                                else if (islower(*px))
                                          *py++ = toupper(*px);
                                if (index("ATGCU",*(py-1)))
                                          natgc++;
                      }
            }
            *py++ = '\0';
            *py = '\0';
            (void) fclose(fp);
            dna = natgc > (tlen/3);
            return(pseq+4);
} char     *
g_calloc(msg, nx, sz)
            char     *msg;          /* program, calling routine */
            int      nx, sz;        /* number and size of elements */
{
            char     *px, *calloc();

if ((px = calloc((unsigned)nx, (unsigned)sz)) == 0) {
                      if (*msg) {
                                fprintf(stderr, "%s: g_calloc() failed %s (n=%d, sz=%d)\n", prog, msg, nx, sz);
                                exit(1);
                      }
            }
            return(px);
}

/*
 * get final jmps from dx[] or tmp file, set pp[], reset dmax: main()
 */
readjmps()
{
            int            fd = -1;
            int            siz, i0, i1;
            register       i, j, xx;

if (fj) {
                      (void) fclose(fj);
                      if ((fd = open(jname, O_RDONLY, 0)) < 0) {
                                fprintf(stderr, "%s: can't open() %s\n", prog, jname);
                                cleanup(1);
                      }
            }
            for (i = i0 = i1 = 0, dmax0 = dmax, xx = len0; ; i++) {
                      while (1) {
                                for (j = dx[dmax].ijmp; j >= 0 && dx[dmax].jp.x[j] >= xx; j--)
                                          ;
``` g_calloc readjmps

Table 1 (cont')

...readjmps

```
                if (j < 0 && dx[dmax].offset && fj) {
                        (void) lseek(fd, dx[dmax].offset, 0);
                        (void) read(fd, (char *)&dx[dmax].jp, sizeof(struct jmp));
                        (void) read(fd, (char *)&dx[dmax].offset, sizeof(dx[dmax].offset));
                        dx[dmax].ijmp = MAXJMP-1;
                }
                else
                        break;
        }
        if (i >= JMPS) {
                fprintf(stderr, "%s: too many gaps in alignment\n", prog);
                cleanup(1);
        }
        if (j >= 0) {
                siz = dx[dmax].jp.n[j];
                xx = dx[dmax].jp.x[j];
                dmax += siz;
                if (siz < 0) {                          /* gap in second seq */
                        pp[1].n[i1] = -siz;
                        xx += siz;
                        /* id = xx - yy + len1 - 1
                        */
                        pp[1].x[i1] = xx - dmax + len1 - 1;
                        gapy++;
                        ngapy -= siz;
/* ignore MAXGAP when doing endgaps */
                        siz = (-siz < MAXGAP || endgaps)? -siz : MAXGAP;
                        i1++;
                }
                else if (siz > 0) {     /* gap in first seq */
                        pp[0].n[i0] = siz;
                        pp[0].x[i0] = xx;
                        gapx++;
                        ngapx += siz;
/* ignore MAXGAP when doing endgaps */
                        siz = (siz < MAXGAP || endgaps)? siz : MAXGAP;
                        i0++;
                }
        }
        else
                break;
}

/* reverse the order of jmps
*/
for (j = 0, i0--; j < i0; j++, i0--) {
        i = pp[0].n[j]; pp[0].n[j] = pp[0].n[i0]; pp[0].n[i0] = i;
        i = pp[0].x[j]; pp[0].x[j] = pp[0].x[i0]; pp[0].x[i0] = i;
}
for (j = 0, i1--; j < i1; j++, i1--) {
        i = pp[1].n[j]; pp[1].n[j] = pp[1].n[i1]; pp[1].n[i1] = i;
        i = pp[1].x[j]; pp[1].x[j] = pp[1].x[i1]; pp[1].x[i1] = i;
}
if (fd >= 0)
        (void) close(fd);
if (fj) {
        (void) unlink(jname);
        fj = 0;
        offset = 0;
}
}
```

Table 1 (cont')

```
/*
 * write a filled jmp struct offset of the prev one (if any): nw()
 */
writejmps(ix)                                                                    writejmps
        int     ix;
{
        char    *mktemp();

if (!fj) {
                if (mktemp(jname) < 0) {
                        fprintf(stderr, "%s: can't mktemp() %s\n", prog, jname);
                        cleanup(1);
                }
                if ((fj = fopen(jname, "w")) == 0) {
                        fprintf(stderr, "%s: can't write %s\n", prog, jname);
                        exit(1);
                }
        }
        (void) fwrite((char *)&dx[ix].jp, sizeof(struct jmp), 1, fj);
        (void) fwrite((char *)&dx[ix].offset, sizeof(dx[ix].offset), 1, fj);
}
```

TABLE 2

| TAT | XXXXXXXXXXXXXXX | (Length = 15 amino acids) |
| Comparison Protein | XXXXXYYYYYYY | (Length = 12 amino acids) |

% amino acid sequence identity = (the number of identically matching amino acid residues between the two polypeptide sequences as determined by ALIGN-2) divided by (the total number of amino acid residues of the TAT polypeptide) = 5 divided by 15 = 33.3%

TABLE 3

| TAT | XXXXXXXXXX | (Length = 10 amino acids) |
| Comparison Protein | XXXXXYYYYYZZYZ | (Length = 15 amino acids) |

% amino acid sequence identity = (the number of identically matching amino acid residues between the two polypeptide sequences as determined by ALIGN-2) divided by (the total number of amino acid residues of the TAT polypeptide) = 5 divided by 10 = 50%

TABLE 4

| TAT-DNA | NNNNNNNNNNNNNN | (Length = 14 nucleotides) |
| Comparison DNA | NNNNNNLLLLLLLLLL | (Length = 16 nucleotides) |

% nucleic acid sequence identity = (the number of identically matching nucleotides between the two nucleic acid sequences as determined by ALIGN-2) divided by (the total number of nucleotides of the TAT-DNA nucleic acid sequence) = 6 divided by 14 = 42.9%

TABLE 5

| TAT-DNA | NNNNNNNNNNNN | (Length = 12 nucleotides) |
| Comparison DNA | NNNNLLLVV | (Length = 9 nucleotides) |

% nucleic acid sequence identity = (the number of identically matching nucleotides between the two nucleic acid sequences as determined by ALIGN-2) divided by (the total number of nucleotides of the TAT-DNA nucleic acid sequence) = 4 divided by 12 = 33.3%

II. Compositions and Methods of the Invention

A. Anti-TAT Antibodies

In one embodiment, the present invention provides anti-TAT antibodies which may find use herein as therapeutic and/or diagnostic agents. Exemplary antibodies include polyclonal, monoclonal, humanized, bispecific, and heteroconjugate antibodies.

1. Polyclonal Antibodies

Polyclonal antibodies are preferably raised in animals by multiple subcutaneous (sc) or intraperitoneal (ip) injections of the relevant antigen and an adjuvant. It may be useful to conjugate the relevant antigen (especially when synthetic peptides are used) to a protein that is immunogenic in the species to be immunized. For example, the antigen can be conjugated to keyhole limpet hemocyanin (KLH), serum albumin, bovine thyroglobulin, or soybean trypsin inhibitor, using a bifunctional or derivatizing agent, e.g., maleimidobenzoyl sulfosuccinimide ester (conjugation through cysteine residues), N-hydroxysuccinimide (through lysine residues), glutaraldehyde, succinic anhydride, $SOCl_2$, or $R^1N=C=NR$, where R and $R^1$ are different alkyl groups.

Animals are immunized against the antigen, immunogenic conjugates, or derivatives by combining, e.g., 100 μg or 5 μg of the protein or conjugate (for rabbits or mice, respectively) with 3 volumes of Freund's complete adjuvant and injecting the solution intradermally at multiple sites. One month later, the animals are boosted with ⅕ to ⅒ the original amount of peptide or conjugate in Freund's complete adjuvant by subcutaneous injection at multiple sites. Seven to 14 days later, the animals are bled and the serum is assayed for antibody titer. Animals are boosted until the titer plateaus. Conjugates also can be made in recombinant cell culture as protein fusions. Also, aggregating agents such as alum are suitably used to enhance the immune response.

2. Monoclonal Antibodies

Monoclonal antibodies may be made using the hybridoma method first described by Kohler et al., *Nature*, 256:495 (1975), or may be made by recombinant DNA methods (U.S. Pat. No. 4,816,567).

In the hybridoma method, a mouse or other appropriate host animal, such as a hamster, is immunized as described above to elicit lymphocytes that produce or are capable of producing antibodies that will specifically bind to the protein used for immunization. Alternatively, lymphocytes may be immunized in vitro. After immunization, lymphocytes are isolated and then fused with a myeloma cell line using a suitable fusing agent, such as polyethylene glycol, to form a hybridoma cell (Goding, *Monoclonal Antibodies: Principles and Practice*, pp. 59-103 (Academic Press, 1986)).

The hybridoma cells thus prepared are seeded and grown in a suitable culture medium which medium preferably contains one or more substances that inhibit the growth or survival of the unfused, parental myeloma cells (also referred to as fusion partner). For example, if the parental myeloma cells lack the enzyme hypoxanthine guanine phosphoribosyl transferase (HGPRT or HPRT), the selective culture medium for the hybridomas typically will include hypoxanthine, aminopterin, and thymidine (HAT medium), which substances prevent the growth of HGPRT-deficient cells.

Preferred fusion partner myelomacells are those that fuse efficiently, support stable high-level production of antibody by the selected antibody-producing cells, and are sensitive to a selective medium that selects against the unfused parental cells. Preferred myeloma cell lines are murine myeloma lines, such as those derived from MOPC-21 and MPC-11 mouse tumors available from the Salk Institute Cell Distribution Center, San Diego, Calif. USA, and SP-2 and derivatives e.g., X63-Ag8-653 cells available from the American Type Culture Collection, Manassas, Va., USA. Human myeloma and mouse-human heteromyeloma cell lines also have been described for the production of human monoclonal antibodies (Kozbor, *J. Immunol.*, 133:3001 (1984); and Brodeur et al., *Monoclonal Antibody Production Techniques and Applications*, pp. 51-63 (Marcel Dekker, Inc., New York, 1987)).

Culture medium in which hybridoma cells are growing is assayed for production of monoclonal antibodies directed against the antigen. Preferably, the binding specificity of monoclonal antibodies produced by hybridoma cells is determined by immunoprecipitation or by an in vitro binding assay, such as radioimmunoassay (RIA) or enzyme-linked immunosorbent assay (ELISA).

The binding affinity of the monoclonal antibody can, for example, be determined by the Scatchard analysis described in Munson et al., *Anal. Biochem.*, 107:220 (1980).

Once hybridoma cells that produce antibodies of the desired specificity, affinity, and/or activity are identified, the clones may be subcloned by limiting dilution procedures and grown by standard methods (Goding, *Monoclonal Antibodies: Principles and Practice*, pp.59-103 (Academic Press, 1986)). Suitable culture media for this purpose include, for example, D-MEM or RPMI-1640 medium. In addition, the hybridoma cells may be grown in vivo as ascites tumors in an animal e.g., , by i.p. injection of the cells into mice.

The monoclonal antibodies secreted by the subclones are suitably separated from the culture medium, ascites fluid, or serum by conventional antibody purification procedures such as, for example, affinity chromatography (e.g., using protein A or protein G-Sepharose) or ion-exchange chromatography, hydroxylapatite chromatography, gel electrophoresis, dialysis, etc.

DNA encoding the monoclonal antibodies is readily isolated and sequenced using conventional procedures (e.g., by using oligonucleotide probes that are capable of binding specifically to genes encoding the heavy and light chains of murine antibodies). The hybridoma cells serve as a preferred source of such DNA. Once isolated, the DNA may be placed into expression vectors, which are then transfected into host cells such as *E. coli* cells, simian COS cells, Chinese Hamster Ovary (CHO) cells, or myeloma cells that do not otherwise produce antibody protein, to obtain the synthesis of monoclonal antibodies in the recombinant host cells. Review articles on recombinant expression in bacteria of DNA encoding the antibody include Skerra et al., *Curr. Opinion in Immunol.,* 5:256-262 (1993) and Plückthun, *Immunol. Revs.* 130: 151-188 (1992).

In a further embodiment, monoclonal antibodies or antibody fragments can be isolated from antibody phage libraries generated using the techniques described in McCafferty et al., *Nature,* 348:552-554 (1990). Clackson et al., *Nature,* 352: 624-628 (1991) and Marks et al., *J. Mol. Biol.,* 222:581-597 (1991) describe the isolation of murine and human antibodies, respectively, using phage libraries. Subsequent publications describe the production of high affinity (nM range) human antibodies by chain shuffling (Marks et al., *Bio/Technology,* 10:779-783 (1992)), as well as combinatorial infection and in vivo recombination as a strategy for constructing very large phage libraries (Waterhouse et al., *Nuc. Acids. Res.* 21:2265-2266 (1993)). Thus, these techniques are viable alternatives to traditional monoclonal antibody hybridoma techniques for isolation of monoclonal antibodies.

The DNA that encodes the antibody may be modified to produce chimeric or fusion antibody polypeptides, for example, by substituting human heavy chain and light chain constant domain ($C_H$ and $C_L$) sequences for the homologous murine sequences (U.S. Pat. No. 4,816,567; and Morrison, et al., *Proc. Natl Acad. Sci. USA,* 81:6851 (1984)), or by fusing the immunoglobulin coding sequence with all or part of the coding sequence for a non-immunoglobulin polypeptide (heterologous polypeptide). The non-immunoglobulin polypeptide sequences can substitute for the constant domains of an antibody, or they are substituted for the variable domains of one antigen-combining site of an antibody to create a chimeric bivalent antibody comprising one antigen-combining site having specificity for an antigen and another antigen-combining site having specificity for a different antigen.

3. Human and Humanized Antibodies

The anti-TAT antibodies of the invention may further comprise humanized antibodies or human antibodies. Humanized forms of non-human (e.g., murine) antibodies are chimeric immunoglobulins, immunoglobulin chains or fragments thereof (such as Fv, Fab, Fab', F(ab')$_2$ or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., *Nature* 321:522-525 (1986); Riechmann et al., *Nature,* 332:323-329 (1988); and Presta, *Curr. Op. Struct. Biol.,* 2:593-596 (1992)].

Methods for humanizing non-human antibodies are well known in the art. Generally, a humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers [Jones et al., *Nature,* 321:522-525 (1986); Riechmann et al., *Nature,* 332:323-327 (1988); Verhoeyen et al. *Science,* 239:1534-1536 (1988)], by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

The choice of human variable domains, both light and heavy, to be used in making the humanized antibodies is very important to reduce antigenicity and HAMA response (human anti-mouse antibody) when the antibody is intended for human therapeutic use. According to the so-called "best-fit" method, the sequence of the variable domain of a rodent antibody is screened against the entire library of known human variable domain sequences. The human V domain sequence which is closest to that of the rodent is identified and the human framework region (FR) within it accepted for the humanized antibody (Sims et al., *J. Immunol.* 151:2296 (1993); Chothia et al., *J. Mol. Biol.,* 196:901 (1987)). Another method uses a particular framework region derived from the consensus sequence of all human antibodies of a particular subgroup of light or heavy chains. The same framework may be used for several different humanized antibodies (Carter et al., *Proc. Natl. Acad. Sci. USA,* 89:4285 (1992); Presta et al., *J. Immunol.* 151:2623 (1993)).

It is further important that antibodies be humanized with retention of high binding affinity for the antigen and other favorable biological properties. To achieve this goal, according to a preferred method, humanized antibodies are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the recipient and import sequences so that the desired antibody characteristic, such as increased affinity for the target antigen(s), is achieved. In general, the hypervariable region residues are directly and most substantially involved in influencing antigen binding.

Various forms of a humanized anti-TAT antibody are contemplated. For example, the humanized antibody may be an antibody fragment, such as a Fab, which is optionally conjugated with one or more cytotoxic agent(s) in order to generate an immunoconjugate. Alternatively, the humanized antibody may be an intact antibody, such as an intact IgG1 antibody.

As an alternative to humanization, human antibodies can be generated. For example, it is now possible to produce transgenic animals (e.g., mice) that are capable, upon immunization, of producing a full repertoire of human antibodies in the absence of endogenous immunoglobulin production. For example, it has been described that the homozygous deletion of the antibody heavy-chain joining region ($J_H$) gene in chimeric and germ-line mutant mice results in complete inhibition of endogenous antibody production. Transfer of the human germ-line immunoglobulin gene array into such germ-line mutant mice will result in the production of human antibodies upon antigen challenge. See, e.g., Jakobovits et al., *Proc. Natl. Acad. Sci. USA,* 90:2551 (1993); Jakobovits et al., *Nature,* 362:255-258 (1993); Bruggemann et al., *Year in Immuno.* 7:33 (1993); U.S. Pat. Nos. 5,545,806, 5,569,825, 5,591,669 (all of GenPharm); U.S. Pat. No. 5,545,807; and WO 97/17852.

Alternatively, phage display technology (McCafferty et al., *Nature* 348:552-553 [1990]) can be used to produce human antibodies and antibody fragments in vitro, from immunoglobulin variable (V) domain gene repertoires from unimmunized donors. According to this technique, antibody V domain genes are cloned in-frame into either a major or minor coat protein gene of a filamentous bacteriophage, such as M13 or fd, and displayed as functional antibody fragments on the surface of the phage particle. Because the filamentous particle contains a single-stranded DNA copy of the phage genome, selections based on the functional properties of the antibody also result in selection of the gene encoding the antibody exhibiting those properties. Thus, the phage mimics some of the properties of the B-cell. Phage display can be performed in a variety of formats, reviewed in, e.g., Johnson, Kevin S. and Chiswell, David J., *Current Opinion in Structural Biology* 3:564-571 (1993). Several sources of V-gene segments can be used for phage display. Clackson et al., *Nature,* 352:624-628 (1991) isolated a diverse array of anti-oxazolone antibodies from a small random combinatorial library of V genes derived from the spleens of immunized mice. A repertoire of V genes from unimmunized human donors can be constructed and antibodies to a diverse array of antigens (including self-antigens) can be isolated essentially following the techniques described by Marks et al., *J. Mol. Biol.* 222:581-597 (1991), or Griffith et al., *EMBO J.* 12:725-734 (1993). See, also, U.S. Pat. Nos. 5,565,332 and 5,573,905.

As discussed above, human antibodies may also be generated by in vitro activated B cells (see U.S. Pat. Nos. 5,567,610 and 5,229,275).

4. Antibody Fragments

In certain circumstances there are advantages of using antibody fragments, rather than whole antibodies. The smaller size of the fragments allows for rapid clearance, and may lead to improved access to solid tumors.

Various techniques have been developed for the production of antibody fragments. Traditionally, these fragments were derived via proteolytic digestion of intact antibodies (see, e.g., Morimoto et al., *Journal of Biochemical and Biophysical Methods* 24:107-117 (1992); and Brennan et al., *Science,* 229:81 (1985)). However, these fragments can now be produced directly by recombinant host cells. Fab, Fv and ScFv antibody fragments can all be expressed in and secreted from *E. coli*, thus allowing the facile production of large amounts of these fragments. Antibody fragments can be isolated from the antibody phage libraries discussed above. Alternatively, Fab'-SH fragments can be directly recovered from *E. coli* and chemically coupled to form $F(ab')_2$ fragments (Carter et al., *Bio/Technology* 10:163-167 (1992)). According to another approach, $F(ab')_2$ fragments can be isolated directly from recombinant host cell culture. Fab and $F(ab')_2$ fragment with increased in vivo half-life comprising a salvage receptor binding epitope residues are described in U.S. Pat. No. 5,869,046. Other techniques for the production of antibody fragments will be apparent to the skilled practitioner. In other embodiments, the antibody of choice is a single chain Fv fragment (scFv). See WO 93/16185; U.S. Pat. No. 5,571,894; and U.S. Pat. No. 5,587,458. Fv and sFv are the only species with intact combining sites that are devoid of constant regions; thus, they are suitable for reduced nonspecific binding during in vivo use. sFv fusion proteins may be constructed to yield fusion of an effector protein at either the amino or the carboxy terminus of an sFv. See *Antibody Engineering*, ed. Borrebaeck, supra. The antibody fragment may also be a "linear antibody", e.g., as described in U.S. Pat. No. 5,641,870 for example. Such linear antibody fragments may be monospecific or bispecific.

5. Bispecific Antibodies

Bispecific antibodies are antibodies that have binding specificities for at least two different epitopes. Exemplary bispecific antibodies may bind to two different epitopes of a TAT protein as described herein. Other such antibodies may combine a TAT binding site with a binding site for another protein. Alternatively, an anti-TAT arm may be combined with an arm which binds to a triggering molecule on a leukocyte such as a T-cell receptor molecule (e.g. CD3), or Fc receptors for IgG (FcγR), such as FcγRI (CD64), FcγRII (CD32) and FcγRIII (CD16), so as to focus and localize cellular defense mechanisms to the TAT-expressing cell. Bispecific antibodies may also be used to localize cytotoxic agents to cells which express TAT. These antibodies possess a TAT-binding arm and an arm which binds the cytotoxic agent (e.g., saporin, anti-interferon-α, vinca alkaloid, ricin A chain, methotrexate or radioactive isotope hapten). Bispecific antibodies can be prepared as full length antibodies or antibody fragments (e.g., $F(ab')_2$ bispecific antibodies).

WO 96/16673 describes a bispecific anti-ErbB2/anti-FcγRIII antibody and U.S. Pat. No. 5,837,234 discloses a bispecific anti-ErbB2/anti-FcγRI antibody. A bispecific anti-ErbB2/Fc α antibody is shown in WO98/02463. U.S. Pat. No. 5,821,337 teaches a bispecific anti-ErbB2/anti-CD3 antibody.

Methods for making bispecific antibodies are known in the art. Traditional production of full length bispecific antibodies is based on the co-expression of two immunoglobulin heavy chain-light chain pairs, where the two chains have different specificities (Millstein et al., *Nature* 305:537-539 (1983)).

Because of the random assortment of immunoglobulin heavy and light chains, these hybridomas (quadromas) produce a potential mixture of 10 different antibody molecules, of which only one has the correct bispecific structure. Purification of the correct molecule, which is usually done by affinity chromatography steps, is rather cumbersome, and the product yields are low. Similar procedures are disclosed in WO 93/08829, and in Traunecker et al., *EMBO J.* 10:3655-3659 (1991).

According to a different approach, antibody variable domains with the desired binding specificities (antibody-antigen combining sites) are fused to immunoglobulin constant domain sequences. Preferably, the fusion is with an Ig heavy chain constant domain, comprising at least part of the hinge, $C_H2$, and $C_H3$ regions. It is preferred to have the first heavy-chain constant region ($C_H1$) containing the site necessary for light chain bonding, present in at least one of the fusions. DNAs encoding the immunoglobulin heavy chain fusions and, if desired, the immunoglobulin light chain, are inserted into separate expression vectors, and are co-transfected into a suitable host cell. This provides for greater flexibility in adjusting the mutual proportions of the three polypeptide fragments in embodiments when unequal ratios of the three polypeptide chains used in the construction provide the optimum yield of the desired bispecific antibody. It is, however, possible to insert the coding sequences for two or all three polypeptide chains into a single expression vector when the expression of at least two polypeptide chains in equal ratios results in high yields or when the ratios have no significant affect on the yield of the desired chain combination.

In a preferred embodiment of this approach, the bispecific antibodies are composed of a hybrid immunoglobulin heavy chain with a first binding specificity in one arm, and a hybrid immunoglobulin heavy chain-light chain pair (providing a second binding specificity) in the other arm. It was found that this asymmetric structure facilitates the separation of the desired bispecific compound from unwanted immunoglobulin chain combinations, as the presence of an immunoglobulin light chain in only one half of the bispecific molecule provides for a facile way of separation. This approach is disclosed in WO 94/04690. For further details of generating bispecific antibodies see, for example, Suresh et al., *Methods in Enzymology* 121:210 (1986).

According to another approach described in U.S. Pat. No. 5,731,168, the interface between a pair of antibody molecules can be engineered to maximize the percentage of heterodimers which are recovered from recombinant cell culture. The preferred interface comprises at least a part of the $C_H3$ domain. In this method, one or more small amino acid side chains from the interface of the first antibody molecule are replaced with larger side chains (e.g., tyrosine or tryptophan). Compensatory "cavities" of identical or similar size to the large side chain(s) are created on the interface of the second antibody molecule by replacing large amino acid side chains with smaller ones (e.g., alanine or threonine). This provides a mechanism for increasing the yield of the heterodimer over other unwanted end-products such as homodimers.

Bispecific antibodies include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676,980), and for treatment of HIV infection (WO 91/00360, WO 92/200373, and EP 03089). Heteroconjugate antibodies may be made using any convenient cross-linking methods. Suitable cross-linking agents are well known in the art, and are disclosed in U.S. Pat. No. 4,676,980, along with a number of cross-linking techniques.

Techniques for generating bispecific antibodies from antibody fragments have also been described in the literature. For example, bispecific antibodies can be prepared using chemical linkage. Brennan et al., *Science* 229:81 (1985) describe a procedure wherein intact antibodies are proteolytically cleaved to generate F(ab')$_2$ fragments. These fragments are reduced in the presence of the dithiol complexing agent, sodium arsenite, to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Recent progress has facilitated the direct recovery of Fab'-SH fragments from *E. coli*, which can be chemically coupled to form bispecific antibodies. Shalaby et al., *J. Exp. Med.* 175: 217-225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets. Various techniques for making and isolating bispecific antibody fragments directly from recombinant cell culture have also been described. For example, bispecific antibodies have been produced using leucine zippers. Kostelny et al., *J. Immunol.* 148(5):1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444-6448 (1993) has provided an alternative mechanism for making bispecific antibody fragments. The fragments comprise a $V_H$ connected to a $V_L$ by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See Gruber et al., *J. Immunol.*, 152:5368 (1994).

Antibodies with more than two valencies are contemplated. For example, trispecific antibodies can be prepared. Tutt et al., *J. Immunol.* 147:60 (1991).

6. Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells [U.S. Pat. No. 4,676,980], and for treatment of HIV infection [WO 91/00360; WO 92/200373; EP 03089]. It is contemplated that the antibodies may be prepared in vitro using known methods in synthetic protein chemistry, including those involving crosslinking agents. For example, immunotoxins may be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

7. Multivalent Antibodies

A multivalent antibody may be internalized (and/or catabolized) faster than a bivalent antibody by a cell expressing an antigen to which the antibodies bind. The antibodies of the present invention can be multivalent antibodies (which are other than of the IgM class) with three or more antigen binding sites (e.g. tetravalent antibodies), which can be readily produced by recombinant expression of nucleic acid encoding the polypeptide chains of the antibody. The multivalent antibody can comprise a dimerization domain and three or more antigen binding sites. The preferred dimerization domain comprises (or consists of) an Fc region or a hinge region. In this scenario, the antibody will comprise an Fc region and three or more antigen binding sites amino-terminal to the Fc region. The preferred multivalent antibody herein comprises (or consists of) three to about eight, but preferably four, antigen binding sites. The multivalent antibody comprises at least one polypeptide chain (and preferably two polypeptide chains), wherein the polypeptide chain(s) comprise two or more variable domains. For instance, the polypeptide chain(s) may comprise VD1-(X1)$_n$-VD2-(X2)$_n$-Fc, wherein VD1 is a first variable domain, VD2 is a second variable domain, Fc is one polypeptide chain of an Fc region, X1 and X2 represent an amino acid or polypeptide, and n is 0 or 1. For instance, the polypeptide chain(s) may comprise: VH-CH1-flexible linker-VH-CH1-Fc region chain; or VH-CH1-VH-CH1-Fc region chain. The multivalent antibody herein preferably further comprises at least two (and preferably four) light chain variable domain polypeptides. The multivalent antibody herein may, for instance, comprise from about two to about eight light chain variable domain polypeptides. The light chain variable domain polypeptides contemplated here comprise a light chain variable domain and, optionally, further comprise a CL domain.

8. Effector Function Engineering

It may be desirable to modify the antibody of the invention with respect to effector function, e.g., so as to enhance antigen-dependent cell-mediated cyotoxicity (ADCC) and/or complement dependent cytotoxicity (CDC) of the antibody. This may be achieved by introducing one or more amino acid substitutions in an Fc region of the antibody. Alternatively or additionally, cysteine residue(s) may be introduced in the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., *J. Exp Med.* 176:1191-1195 (1992) and Shopes, B. *J. Immunol.* 148:2918-2922 (1992). Homodimeric antibodies with enhanced anti-tumor activity may also be prepared using heterobifunctional cross-linkers as described in Wolff et al., *Cancer Research* 53:2560-2565 (1993). Alternatively, an antibody can be engineered which has dual Fc regions and may thereby have enhanced complement lysis and ADCC capabilities. See Stevenson et al., *Anti-Cancer Drug Design* 3:219-230 (1989). To increase the serum half life of the antibody, one may incorporate a salvage receptor binding epitope into the antibody (especially an antibody fragment) as described in U.S. Pat. No. 5,739,277, for example. As used herein, the term "salvage receptor binding epitope" refers to an epitope of the Fc region of an IgG molecule (e.g., IgG$_1$, IgG$_2$, IgG$_3$, or IgG$_4$) that is responsible for increasing the in vivo serum half-life of the IgG molecule.

9. Immunoconjugate

The invention also pertains to immunoconjugates comprising an antibody conjugated to a cytotoxic agent such as a chemotherapeutic agent, a growth inhibitory agent, a toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re. Conjugates of the antibody and cytotoxic agent are made using a variety of bifunctional protein-coupling agents such as N-succinimidyl-3-(2-pyridyldithiol)propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis(p-azidobenzoyl)hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science,* 238: 1098 (1987). Carbon-14-labeled 1-isothiocyanatobenzyl-3-methyidiethylene triaminepentaacetic acid (MX-DTPA) is an exemplary chelating agent for conjugation of radionucleotide to the antibody. See WO94/11026.

Conjugates of an antibody and one or more small molecule toxins, such as a calicheamicin, maytansinoids, a trichothene, and CC1065, and the derivatives of these toxins that have toxin activity, are also contemplated herein.

Maytansine and Maytansinoids

In one preferred embodiment, an anti-TAT antibody (full length or fragments) of the invention is conjugated to one or more maytansinoid molecules.

Maytansinoids are mitototic inhibitors which act by inhibiting tubulin polymerization. Maytansine was first isolated from the east African shrub Maytenus serrata (U.S. Pat. No. 3,896,111). Subsequently, it was discovered that certain microbes also produce maytansinoids, such as maytansinol and C-3 maytansinol esters (U.S. Pat. No. 4,151,042). Synthetic maytansinol and derivatives and analogues thereof are disclosed, for example, in U.S. Pat. Nos. 4,137,230; 4,248,870; 4,256,746; 4,260,608; 4,265,814; 4,294,757; 4,307,016; 4,308,268; 4,308,269; 4,309,428; 4,313,946; 4,315,929; 4,317,821; 4,322,348; 4,331,598; 4,361,650; 4,364,866; 4,424,219; 4,450,254; 4,362,663; and 4,371,533, the disclosures of which are hereby expressly incorporated by reference.

Maytansinoid-Antibody Conjugates

In an attempt to improve their therapeutic index, maytansine and maytansinoids have been conjugated to antibodies specifically binding to tumor cell antigens. Immunoconjugates containing maytansinoids and their therapeutic use are disclosed, for example, in U.S. Pat. Nos. 5,208,020, 5,416,064 and European Patent EP 0 425 235 B1, the disclosures of which are hereby expressly incorporated by reference. Liu et al., *Proc. Natl. Acad. Sci. USA* 93:8618-8623 (1996) described immunoconjugates comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay. Chari et al., *Cancer Research* 52:127-131 (1992) describe immunoconjugates in which a maytansinoid was conjugated via a disulfide linker to the murine antibody A7 binding to an antigen on human colon cancer cell lines, or to another murine monoclonal antibody TA.1 that binds the HER-2/neu oncogene. The cytotoxicity of the TA.1-maytansonoid conjugate was tested in vitro on the human breast cancer cell line SK-BR-3, which expresses $3 \times 10^5$ HER-2 surface antigens per cell. The drug conjugate achieved a degree of cytotoxicity similar to the free maytansonid drug, which could be increased by increasing the number of maytansinoid molecules per antibody molecule. The A7-maytansinoid conjugate showed low systemic cytotoxicity in mice.

Anti-TAT Polypeptide Antibody-Maytansinoid Conjugates (Immunoconjugate)

Anti-TAT antibody-maytansinoid conjugates are prepared by chemically linking an anti-TAT antibody to a maytansinoid molecule without significantly diminishing the biological activity of either the antibody or the maytansinoid molecule. An average of 3-4 maytansinoid molecules conjugated per antibody molecule has shown efficacy in enhancing cytotoxicity of target cells without negatively affecting the function or solubility of the antibody, although even one molecule of toxin/antibody would be expected to enhance cytotoxicity over the use of naked antibody. Maytansinoids are well known in the art and can be synthesized by known techniques or isolated from natural sources. Suitable maytansinoids are disclosed, for example, in U.S. Pat. No. 5,208,020 and in the other patents and nonpatent publications referred to hereinabove. Preferred maytansinoids are maytansinol and maytansinol analogues modified in the aromatic ring or at other positions of the maytansinol molecule, such as various maytansinol esters.

There are many linking groups known in the art for making antibody-maytansinoid conjugates, including, for example, those disclosed in U.S. Pat. No. 5,208,020 or EP Patent 0 425 235 B1, and Chari et al., *Cancer Research* 52:127-131 (1992). The linking groups include disufide groups, thioether groups, acid labile groups, photolabile groups, peptidase labile groups, or esterase labile groups, as disclosed in the above-identified patents, disulfide and thioether groups being preferred.

Conjugates of the antibody and maytansinoid may be made using a variety of bifunctional protein coupling agents such as N-succinimidyl-3-(2-pyridyidithio)propionate (SPDP), succinimidyl-4-(N-maleimidomethyl)cyclohexane-1-carboxylate, iminothiolane (IT), bifunctional derivatives of imidoesters (such as dimethyl adipimidate HCL), active esters (such as disuccinimidyl suberate), aldehydes (such as glutareldehyde), bis-azido compounds (such as bis(p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). Particularly preferred coupling agents include N-succinimidyl-3-(2-pyridyldithio)propionate (SPDP) (Carlsson et al., *Biochem. J.* 173:723-737 [1978]) and N-succinimidyl-4-(2-pyridylthio)pentanoate (SPP) to provide for a disulfide linkage.

The linker may be attached to the maytansinoid molecule at various positions, depending on the type of the link. For example, an ester linkage may be formed by reaction with a hydroxyl group using conventional coupling techniques. The reaction may occur at the C-3 position having a hydroxyl group, the C-14 position modified with hyrdoxymethyl, the C-15 position modified with a hydroxyl group, and the C-20 position having a hydroxyl group. In a preferred embodiment, the linkage is formed at the C-3 position of maytansinol or a maytansinol analogue.

Calicheamicin

Another immunoconjugate of interest comprises an anti-TAT antibody conjugated to one or more calicheamicin molecules. The calicheamicin family of antibiotics are capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296 (all to American Cyanamid Company). Structural analogues of calicheamicin which may be used include, but are not limited to, $\gamma_1^I$, $\alpha_2^I$, $\alpha_3^I$, N-acetyl-$\gamma_1^I$, PSAG and $\theta^I_1$ (Hinman et al., *Cancer Research* 53:3336-3342 (1993), Lode et al. *Cancer Research* 58:2925-2928 (1998) and the aforementioned U.S. patents to American Cyanamid). Another anti-tumor drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

Other Cytotoxic Agents

Other antitumor agents that can be conjugated to the anti-TAT antibodies of the invention include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof which can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin and the tricothecenes. See, for example, WO 93/21232 published Oct. 28, 1993.

The present invention further contemplates an immunoconjugate formed between an antibody and a compound with nucleolytic activity (e.g., a ribonuclease or a DNA endonuclease such as a deoxyribonuclease; DNase).

For selective destruction of the tumor, the antibody may comprise a highly radioactive atom. A variety of radioactive isotopes are available for the production of radioconjugated anti-TAT antibodies. Examples include $At^{211}$, $I^{131}$, $I^{125}$, $Y^{90}$, $Re^{186}$, $Re^{188}$, $Sm^{153}$, $Bi^{212}$, $P^{32}$, $Pb^{212}$ and radioactive isotopes of Lu. When the conjugate is used for diagnosis, it may comprise a radioactive atom for scintigraphic studies, for example $tc^{99m}$ or $I^{123}$, or a spin label for nuclear magnetic resonance (NMR) imaging (also known as magnetic resonance imaging, mri), such as iodine-123 again, iodine-131, indium-111, fluorine-19, carbon-13, nitrogen-15, oxygen-17, gadolinium, manganese or iron.

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as $tc^{99m}$ or $I^{123}$, $Re^{186}$, $Re^{188}$ and $In^{111}$ can be attached via a cysteine residue in the peptide. Yttrium-90 can be attached via a lysine residue. The IODOGEN method (Fraker et al (1978) Biochem. Biophys. Res. Commun. 80: 49-57 can be used to incorporate iodine-123. "Monoclonal Antibodies in Immunoscintigraphy" (Chatal, CRC Press 1989) describes other methods in detail.

Conjugates of the antibody and cytotoxic agent may be made using a variety of bifunctional protein coupling agents such as N-succinimidyl-3-(2-pyridyldithio)propionate (SPDP), succinimidyl-4-(N-maleimidomethyl)cyclohexane-1-carboxylate, iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science* 238:1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., *Cancer Research* 52:127-131 (1992); U.S. Pat. No. 5,208,020) may be used.

Alternatively, a fusion protein comprising the anti-TAT antibody and cytotoxic agent may be made, e.g., by recombinant techniques or peptide synthesis. The length of DNA may comprise respective regions encoding the two portions of the conjugate either adjacent one another or separated by a region encoding a linker peptide which does not destroy the desired properties of the conjugate.

In yet another embodiment, the antibody may be conjugated to a "receptor" (such streptavidin) for utilization in tumor pre-targeting wherein the antibody-receptor conjugate is administered to the patient, followed by removal of unbound conjugate from the circulation using a clearing agent and then administration of a "ligand" (e.g., avidin) which is conjugated to a cytotoxic agent (e.g., a radionucleotide).

10. Immunoliposomes

The anti-TAT antibodies disclosed herein may also be formulated as immunoliposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody are prepared by methods known in the art, such as described in Epstein et al., *Proc. Natl. Acad. Sci. USA* 82:3688 (1985); Hwang et al., *Proc. Natl. Acad. Sci. USA* 77:4030 (1980); U.S. Pat. Nos. 4,485,045 and 4,544,545; and WO97/38731 published Oct. 23, 1997. Liposomes with enhanced circulation time are disclosed in U.S. Pat. No. 5,013,556.

Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.* 257: 286-288 (1982) via a disulfide interchange reaction. A chemotherapeutic agent is optionally contained within the liposome. See Gabizon et al., *J. National Cancer Inst.* 81(19): 1484 (1989).

B. TAT Binding Oligopeptides

TAT binding oligopeptides of the present invention are oligopeptides that bind, preferably specifically, to a TAT polypeptide as described herein. TAT binding oligopeptides may be chemically synthesized using known oligopeptide synthesis methodology or may be prepared and purified using recombinant technology. TAT binding oligopeptides are usually at least about 5 amino acids in length, alternatively at least about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 amino acids in length or more, wherein such oligopeptides that are capable of binding, preferably specifically, to a TAT polypeptide as described herein. TAT binding oligopeptides may be identified without undue experimentation using well known techniques. In this regard, it is noted that techniques for screening oligopeptide libraries for oligopeptides that are capable of specifically binding to a polypeptide target are well known in the art (see, e.g., U.S. Pat. Nos. 5,556,762, 5,750,373, 4,708, 871, 4,833,092, 5,223,409, 5,403,484, 5,571,689, 5,663,143; PCT Publication Nos. WO 84/03506 and WO084/03564; Geysen et al., Proc. Natl. Acad. Sci. U.S.A., 81:3998-4002 (1984); Geysen et al., Proc. Natl. Acad. Sci. U.S.A., 82:178-182 (1985); Geysen et al., in Synthetic Peptides as Antigens, 130-149 (1986); Geysen et al., J. Immunol. Meth., 102:259-274 (1987); Schoofs et al., J. Immunol., 140:611-616 (1988), Cwirla, S. E. et al. (1990) Proc. Natl. Acad. Sci. USA, 87:6378; Lowman, H. B. et al. (1991) Biochemistry, 30:10832; Clackson, T. et al. (1991) Nature, 352: 624; Marks, J. D. et al. (1991), J. Mol. Biol., 222:581; Kang, A. S. et al. (1991) Proc. Natl. Acad. Sci. USA, 88:8363, and Smith, G. P. (1991) Current Opin. Biotechnol., 2:668).

In this regard, bacteriophage (phage) display is one well known technique which allows one to screen large oligopeptide libraries to identify member(s) of those libraries which are capable of specifically binding to a polypeptide target. Phage display is a technique by which variant polypeptides are displayed as fusion proteins to the coat protein on the surface of bacteriophage particles (Scott, J. K. and Smith, G. P. (1990) Science 249: 386). The utility of phage display lies in the fact that large libraries of selectively randomized protein variants (or randomly cloned cDNAs) can be rapidly and efficiently sorted for those sequences that bind to a target molecule with high affinity. Display of peptide (Cwirla, S. E. et al. (1990) Proc. Natl. Acad. Sci. USA, 87:6378) or protein (Lowman, H. B. et al. (1991) Biochemistry, 30:10832; Clackson, T. et al. (1991) Nature, 352: 624; Marks, J. D. et al. (1991), J. Mol. Biol., 222:581; Kang, A. S. et al. (1991) Proc. Natl. Acad. Sci. USA, 88:8363) libraries on phage have been used for screening millions of polypeptides or oligopeptides for ones with specific binding properties (Smith, G. P. (1991) Current Opin. Biotechnol., 2:668). Sorting phage libraries of random mutants requires a strategy for constructing and propagating a large number of variants, a procedure for affinity purification using the target receptor, and a means of evaluating the results of binding enrichments. U.S. Pat. Nos. 5,223,409, 5,403,484, 5,571,689, and 5,663,143.

Although most phage display methods have used filamentous phage, lambdoid phage display systems (WO95/34683; U.S. Pat. No. 5,627,024), T4 phagedisplay systems (Ren, Z-J. et al. (1998) Gene 215:439; Zhu, Z. (1997) CAN 33:534; Jiang, J. et al. (1997) can 128:44380; Ren, Z-J. et al. (1997) CAN 127:215644; Ren, Z-J. (1996) Protein Sci. 5:1833; Efimov, V. P. et al. (1995) Virus Genes 10:173) and T7 phage display systems (Smith, G. P. and Scott, J. K. (1993) Methods in Enzymology, 217, 228-257; U.S. Pat. No. 5,766,905) are also known.

Many other improvements and variations of the basic phage display concept have now been developed. These improvements enhance the ability of display systems to screen peptide libraries for binding to selected target molecules and to display functional proteins with the potential of screening these proteins for desired properties. Combinatorial reaction devices for phage display reactions have been developed (WO 98/14277) and phage display libraries have been used to analyze and control bimolecular interactions (WO 98/20169; WO 98/20159) and properties of constrained helical peptides (WO 98/20036). WO 97/35196 describes a method of isolating an affinity ligand in which a phage display library is contacted with one solution in which the ligand will bind to a target molecule and a second solution in which the affinity ligand will not bind to the target molecule, to selectively isolate binding ligands. WO 97/46251 describes a method of biopanning a random phage display library with an affinity purified antibody and then isolating binding phage, followed by a micropanning process using microplate wells to isolate high affinity binding phage. The use of *Staphylococcus aureus* protein A as an affinity tag has also been reported (Li et al. (1998) Mol Biotech., 9:187). WO 97/47314 describes the use of substrate subtraction libraries to distinguish enzyme specificities using a combinatorial library which may be a phage display library. A method for selecting enzymes suitable for use in detergents using phage display is described in WO 97/09446. Additional methods of selecting specific binding proteins are described in U.S. Pat. Nos. 5,498,538, 5,432,018, and WO 98/15833.

Methods of generating peptide libraries and screening these libraries are also disclosed in U.S. Pat. Nos. 5,723,286, 5,432,018, 5,580,717, 5,427,908, 5,498,530, 5,770,434, 5,734,018, 5,698,426, 5,763,192, and 5,723,323.

C. TAT Binding Organic Molecules

TAT binding organic molecules are organic molecules other than oligopeptides or antibodies as defined herein that bind, preferably specifically, to a TAT polypeptide as described herein. TAT binding organic molecules may be identified and chemically synthesized using known methodology (see, e.g., PCT Publication Nos. WO00/00823 and WO00/39585). TAT binding organic molecules are usually less than about 2000 daltons in size, alternatively less than about 1500, 750, 500, 250 or 200 daltons in size, wherein such organic molecules that are capable of binding, preferably specifically, to a TAT polypeptide as described herein may be identified without undue experimentation using well known techniques. In this regard, it is noted that techniques for screening organic molecule libraries for molecules that are capable of binding to a polypeptide target are well known in the art (see, e.g., PCT Publication Nos. WO00/00823 and WO00/39585). TAT binding organic molecules may be, for example, aldehydes, ketones, oximes, hydrazones, semicarbazones, carbazides, primary amines, secondary amines, tertiary amines, N-substituted hydrazines, hydrazides, alcohols, ethers, thiols, thioethers, disulfides, carboxylic acids, esters, amides, ureas, carbamates, carbonates, ketals, thioketals, acetals, thioacetals, aryl halides, aryl sulfonates, alkyl halides, alkyl sulfonates, aromatic compounds, heterocyclic compounds, anilines, alkenes, alkynes, diols, amino alcohols, oxazolidines, oxazolines, thiazolidines, thiazolines, enamines, sulfonamides, epoxides, aziridines, isocyanates, sulfonyl chlorides, diazo compounds, acid chlorides, or the like.

D. Screening for Anti-TAT Antibodies, TAT Binding Oligopeptides and TAT Binding Organic Molecules With the Desired Properties Techniques for generating antibodies, oligopeptides and organic molecules that bind to TAT polypeptides have been described above. One may further select antibodies, oligopeptides or other organic molecules with certain biological characteristics, as desired.

The growth inhibitory effects of an anti-TAT antibody, oligopeptide or other organic molecule of the invention may be assessed by methods known in the art, e.g., using cells which express a TAT polypeptide either endogenously or following transfection with the TAT gene. For example, appropriate tumor cell lines and TAT-transfected cells may treated with an anti-TAT monoclonal antibody, oligopeptide or other organic molecule of the invention at various concentrations for a few days (e.g., 2-7) days and stained with crystal violet or MTT or analyzed by some other colorimetric assay. Another method of measuring proliferation would be by comparing $^3$H-thymidine uptake by the cells treated in the presence or absence an anti-TAT antibody, TAT binding oligopeptide or TAT binding organic molecule of the invention. After treatment, the cells are harvested and the amount of radioactivity incorporated into the DNA quantitated in a scintillation counter. Appropriate positive controls include treatment of a selected cell line with a growth inhibitory antibody known to inhibit growth of that cell line. Growth inhibition of tumor cells in vivo can be determined in various ways known in the art. Preferably, the tumor cell is one that overexpresses a TAT polypeptide. Preferably, the anti-TAT antibody, TAT binding oligopeptide or TAT binding organic molecule will inhibit cell proliferation of a TAT-expressing tumor cell in vitro or in vivo by about 25-100% compared to the untreated tumor cell, more preferably, by about 30-100%, and even more preferably by about 50-100% or 70-100%, in one embodiment, at an antibody concentration of about 0.5 to 30 µg/ml. Growth inhibition can be measured at an antibody concentration of about 0.5 to 30 µg/ml or about 0.5 nM to 200 nM in cell culture, where the growth inhibition is determined 1-10 days after exposure of the tumor cells to the antibody. The antibody is growth inhibitory in vivo if administration of the anti-TAT antibody at about 1 µg/kg to about 100 mg/kg body weight results in reduction in tumor size or reduction of tumor cell proliferation within about 5 days to 3 months from the first administration of the antibody, preferably within about 5 to 30 days.

To select for an anti-TAT antibody, TAT binding oligopeptide or TAT binding organic molecule which induces cell death, loss of membrane integrity as indicated by, e.g., propidium iodide (PI), trypan blue or 7AAD uptake may be assessed relative to control. A PI uptake assay can be performed in the absence of complement and immune effector cells. TAT polypeptide-expressing tumor cells are incubated with medium alone or medium containing the appropriate anti-TAT antibody (e.g., at about 10 µg/ml), TAT binding oligopeptide or TAT binding organic molecule. The cells are incubated for a 3 day time period. Following each treatment, cells are washed and aliquoted into 35 mm strainer-capped 12×75 tubes (1 ml per tube, 3 tubes per treatment group) for removal of cell clumps. Tubes then receive PI (1 µg/ml). Samples may be analyzed using a FACSCAN® flow cytometer and FACSCONVERT® CellQuest software (Becton Dickinson). Those anti-TAT antibodies, TAT binding oligopeptides or TAT binding organic molecules that induce statistically significant levels of cell death as determined by PI uptake may be selected as cell death-inducing anti-TAT antibodies, TAT binding oligopeptides or TAT binding organic molecules.

To screen for antibodies, oligopeptides or other organic molecules which bind to an epitope on a TAT polypeptide bound by an antibody of interest, a routine cross-blocking assay such as that described in *Antibodies, A Laboratory Manual, Cold Spring Harbor Laboratory,* Ed Harlow and David Lane (1988), can be performed. This assay can be used to determine if a test antibody, oligopeptide or other organic molecule binds the same site or epitope as a known anti-TAT antibody. Alternatively, or additionally, epitope mapping can be performed by methods known in the art. For example, the antibody sequence can be mutagenized such as by alanine scanning, to identify contact residues. The mutant antibody is initially tested for binding with polyclonal antibody to ensure proper folding. In a different method, peptides corresponding to different regions of a TAT polypeptide can be used in competition assays with the test antibodies or with a test antibody and an antibody with a characterized or known epitope.

E. Antibody Dependent Enzyme Mediated Prodrug Therapy (ADEPT)

The antibodies of the present invention may also be used in ADEPT by conjugating the antibody to a prodrug-activating enzyme which converts a prodrug (e.g., a peptidyl chemotherapeutic agent, see WO81/01145) to an active anti-cancer drug. See, for example, WO 88/07378 and U.S. Pat. No. 4,975,278.

The enzyme component of the immunoconjugate useful for ADEPT includes any enzyme capable of acting on a prodrug in such a way so as to covert it into its more active, cytotoxic form.

Enzymes that are useful in the method of this invention include, but are not limited to, alkaline phosphatase useful for converting phosphate-containing prodrugs into free drugs; arylsulfatase useful for converting sulfate-containing prodrugs into free drugs; cytosine deaminase useful for converting non-toxic 5-fluorocytosine into the anti-cancer drug, 5-fluorouracil; proteases, such as serratia protease, thermolysin, subtilisin, carboxypeptidases and cathepsins (such as cathepsins B and L), that are useful for converting peptide-containing prodrugs into free drugs; D-alanylcarboxypeptidases, useful for converting prodrugs that contain D-amino acid substituents; carbohydrate-cleaving enzymes such as β-galactosidase and neuraminidase useful for converting glycosylated prodrugs into free drugs; β-lactamase useful for converting drugs derivatized with β-lactams into free drugs; and penicillin amidases, such as penicillin V amidase or penicillin G amidase, useful for converting drugs derivatized at their amine nitrogens with phenoxyacetyl or phenylacetyl groups, respectively, into free drugs. Alternatively, antibodies with enzymatic activity, also known in the art as "abzymes", can be used to convert the prodrugs of the invention into free active drugs (see, e.g., Massey, *Nature* 328:457-458 (1987)). Antibody-abzyme conjugates can be prepared as described herein for delivery of the abzyme to a tumor cell population.

The enzymes of this invention can be covalently bound to the anti-TAT antibodies by techniques well known in the art such as the use of the heterobifunctional crosslinking reagents discussed above. Alternatively, fusion proteins comprising at least the antigen binding region of an antibody of the invention linked to at least a functionally active portion of an enzyme of the invention can be constructed using recombinant DNA techniques well known in the art (see, e.g., Neuberger et al., *Nature* 312:604-608 (1984).

F. Full-Length TAT Polypeptides

The present invention also provides newly identified and isolated nucleotide sequences encoding polypeptides referred to in the present application as TAT polypeptides. In particular, cDNAs (partial and full-length) encoding various TAT polypeptides have been identified and isolated, as disclosed in further detail in the Examples below.

As disclosed in the Examples below, various cDNA clones have been deposited with the ATCC. The actual nucleotide sequences of those clones can readily be determined by the skilled artisan by sequencing of the deposited clone using routine methods in the art. The predicted amino acid sequence can be determined from the nucleotide sequence using routine skill. For the TAT polypeptides and encoding nucleic acids described herein, in some cases, Applicants have identified what is believed to be the reading frame best identifiable with the sequence information available at the time.

G. Anti-TAT Antibody and TAT Polypeptide Variants

In addition to the anti-TAT antibodies and full-length native sequence TAT polypeptides described herein, it is contemplated that anti-TAT antibody and TAT polypeptide variants can be prepared. Anti-TAT antibody and TAT polypeptide variants can be prepared by introducing appropriate nucleotide changes into the encoding DNA, and/or by synthesis of the desired antibody or polypeptide. Those skilled in the art will appreciate that amino acid changes may alter post-translational processes of the anti-TAT antibody or TAT polypeptide, such as changing the number or position of glycosylation sites or altering the membrane anchoring characteristics.

Variations in the anti-TAT antibodies and TAT polypeptides described herein, can be made, for example, using any of the techniques and guidelines for conservative and non-conservative mutations set forth, for instance, in U.S. Patent No. 5, 364, 934. Variations may be a substitution, deletion or insertion of one or more codons encoding the antibody or polypeptide that results in a change in the amino acid sequence as compared with the native sequence antibody or polypeptide. Optionally the variation is by substitution of at least one amino acid with any other amino acid in one or more of the domains of the anti-TAT antibody or TAT polypeptide. Guidance in determining which amino acid residue may be inserted, substituted or deleted without adversely affecting the desired activity may be found by comparing the sequence of the anti-TAT antibody or TAT polypeptide with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

Anti-TAT antibody and TAT polypeptide fragments are provided herein. Such fragments may be truncated at the N-terminus or C-terminus, or may lack internal residues, for example, when compared with a full length native antibody or protein. Certain fragments lack amino acid residues that are not essential for a desired biological activity of the anti-TAT antibody or TAT polypeptide.

Anti-TAT antibody and TAT polypeptide fragments may be prepared by any of a number of conventional techniques. Desired peptide fragments may be chemically synthesized. An alternative approach involves generating antibody or polypeptide fragments by enzymatic digestion, e.g., by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired antibody or polypeptide fragment, by polymerase chain reaction (PCR). Oligonucleotides that define the desired termini of the DNA fragment are employed at the 5' and 3' primers in the PCR. Preferably, anti-TAT antibody and TAT polypeptide fragments share at least one biological and/or immunological activity with the native anti-TAT antibody or TAT polypeptide disclosed herein.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
| --- | --- | --- |
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the anti-TAT antibody or TAT polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

(1) hydrophobic: norleucine, met, ala, val, leu, ile;
(2) neutral hydrophilic: cys, ser, thr;
(3) acidic: asp, glu;
(4) basic: asn, gin, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.*, 13:4331 (1986); Zoller et al., *Nucl. Acids Res.*, 10:6487 (1987)], cassette mutagenesis [Wells et al., *Gene*, 34:315 (1985)], restriction selection mutagenesis [Wells et al., *Philos. Trans. R. Soc. London SerA,* 317:415 (1986)] or other known techniques can be performed on the cloned DNA to produce the anti-TAT antibody or TAT polypeptide variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science,* 244:1081-1085 (1989)]. Alanine is also typically preferred because it is the most common amino acid. Further, it is frequently found in both buried and exposed positions [Creighton, The Proteins, (W. H. Freeman & Co., N.Y.); Chothia, *J. Mol. Biol.,* 150:1 (1976)]. If alanine substitution does not yield adequate amounts of variant, an isoteric amino acid can be used.

Any cysteine residue not involved in maintaining the proper conformation of the anti-TAT antibody or TAT polypeptide also may be substituted, generally with serine, to improve the oxidative stability of the molecule and prevent aberrant crosslinking. Conversely, cysteine bond(s) may be added to the anti-TAT antibody or TAT polypeptide to improve its stability (particularly where the antibody is an antibody fragment such as an Fv fragment).

A particularly preferred type of substitutional variant involves substituting one or more hypervariable region residues of a parent antibody (e.g., a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e.g., 6-7 sites) are mutated to generate all possible amino substitutions at each site. The antibody variants thus generated are displayed in a monovalent fashion from filamentous phage particles as fusions to the gene III product of M13 packaged within each particle. The phage-displayed variants are then screened for their biological activity (e.g., binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the antibody and human TAT polypeptide. Such contact residues and neighboring residues are candidates for substitution according to the techniques elaborated herein. Once such variants are generated, the panel of variants is subjected to screening as described herein and antibodies with superior properties in one or more relevant assays may be selected for further development.

Nucleic acid molecules encoding amino acid sequence variants of the anti-TAT antibody are prepared by a variety of methods known in the art. These methods include, but are not limited to, isolation from a natural source (in the case of naturally occurring amino acid sequence variants) or preparation by oligonucleotide-mediated (or site-directed) mutagenesis, PCR mutagenesis, and cassette mutagenesis of an earlier prepared variant or a non-variant version of the anti-TAT antibody.

H. Modifications of Anti-TAT Antibodies and TAT Polypeptides

Covalent modifications of anti-TAT antibodies and TAT polypeptides are included within the scope of this invention. One type of covalent modification includes reacting targeted amino acid residues of an anti-TAT antibody or TAT polypeptide with an organic derivatizing agent that is capable of reacting with selected side chains or the N- or C-terminal residues of the anti-TAT antibody or TAT polypeptide. Derivatization with bifunctional agents is useful, for instance, for crosslinking anti-TAT antibody or TAT polypeptide to a water-insoluble support matrix or surface for use in the method for purifying anti-TAT antibodies, and vice-versa. Commonly used crosslinking agents include, e.g., 1,1-bis (diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio] propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the a-amino groups of lysine, arginine, and histidine side chains [T. E. Creighton, *Proteins: Structure and Molecular Properties,* W. H. Freeman & Co., San Francisco, pp. 79-86 (1983)], acetylation of the N-terminal amine, and amidation of any C-terminal carboxyl group.

Another type of covalent modification of the anti-TAT antibody or TAT polypeptide included within the scope of this invention comprises altering the native glycosylation pattern of the antibody or polypeptide. "Altering the native glycosylation pattern" is intended for purposes herein to mean deleting one or more carbohydrate moieties found in native sequence anti-TAT antibody or TAT polypeptide (either by removing the underlying glycosylation site or by deleting the glycosylation by chemical and/or enzymatic means), and/or adding one or more glycosylation sites that are not present in the native sequence anti-TAT antibody or TAT polypeptide. In addition, the phrase includes qualitative changes in the glycosylation of the native proteins, involving a change in the nature and proportions of the various carbohydrate moieties present.

Glycosylation of antibodies and other polypeptides is typically either N-linked or O-linked. N-linked refers to the attachment of the carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-aceylgalactosamine, galactose, or xylose to a hydroxyamino acid, most commonly serine or threonine, although 5-hydroxyproline or 5-hydroxylysine may also be used.

Addition of glycosylation sites to the anti-TAT antibody or TAT polypeptide is conveniently accomplished by altering the amino acid sequence such that it contains one or more of the above-described tripeptide sequences (for N-linked glycosylation sites). The alteration may also be made by the addition of, or substitution by, one or more serine or threonine residues to the sequence of the original anti-TAT antibody or TAT polypeptide (for O-linked glycosylation sites). The anti-TAT antibody or TAT polypeptide amino acid sequence may optionally be altered through changes at the DNA level, particularly by mutating the DNA encoding the anti-TAT antibody or TAT polypeptide at preselected bases such that codons are generated that will translate into the desired amino acids.

Another means of increasing the number of carbohydrate moieties on the anti-TAT antibody or TAT polypeptide is by chemical or enzymatic coupling of glycosides to the polypeptide. Such methods are described in the art, e.g., in WO 87/05330 published 11 Sep. 1987, and in Aplin and Wriston, *CRC Crit. Rev. Biochem.,* pp. 259-306 (1981).

Removal of carbohydrate moieties present on the anti-TAT antibody or TAT polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., *Arch. Biochem. Biophys.,* 259:52 (1987) and by Edge et al., *Anal. Biochem.,* 118:131 (1981). Enzymatic cleavage of carbohydrate moieties on polypeptides can be achieved by the use of a variety of endo- and exo-glycosidases as described by Thotakura et al., *Meth. Enzymol.,* 138:350 (1987).

Another type of covalent modification of anti-TAT antibody or TAT polypeptide comprises linking the antibody or polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337. The antibody or polypeptide also may be entrapped in microcapsules prepared, for example, by coacervation techniques or by interfacial polymerization (for example, hydroxymethylcellulose or gelatin-microcapsules and poly-(methylmethacylate) microcapsules, respectively), in colloidal drug delivery systems (for example, liposomes, albumin microspheres, microemulsions, nano-particles and nanocapsules), or in macroemulsions. Such techniques are disclosed in *Remington's Pharmaceutical Sciences,* 16th edition, Oslo, A., Ed., (1980).

The anti-TAT antibody or TAT polypeptide of the present invention may also be modified in a way to form chimeric molecules comprising an anti-TAT antibody or TAT polypeptide fused to another, heterologous polypeptide or amino acid sequence.

In one embodiment, such a chimeric molecule comprises a fusion of the anti-TAT antibody or TAT polypeptide with a tag polypeptide which provides an epitope to which an anti-tag antibody can selectively bind. The epitope tag is generally placed at the amino- or carboxyl-terminus of the anti-TAT antibody or TAT polypeptide. The presence of such epitope-tagged forms of the anti-TAT antibody or TAT polypeptide can be detected using an antibody against the tag polypeptide.

Also, provision of the epitope tag enables the anti-TAT antibody or TAT polypeptide to be readily purified by affinity purification using an anti-tag antibody or another type of affinity matrix that binds to the epitope tag. Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., *Mol. Cell. Biol.*, 8:2159-2165 (1988)]; the c-myc and the 8F9,3C7,6E10, G4, B7 and 9E10 antibodies thereto [Evan et al., *Molecular and Cellular Biology*, 5:3610-3616 (1985)]; and the Herpes Simplex virus glycoprotein D (gD) tag and its antibody [Paborsky et al., *Protein Engineering*, 3(6):547-553 (1990)]. Other tag polypeptides include the Flag-peptide [Hopp et al., *BioTechnology*, 6:1204-1210 (1988)]; the KT3 epitope peptide [Martin et al., *Science*, 255:192-194 (1992)]; an α-tubulin epitope peptide [Skinner et al., *J. Biol. Chem.*, 266:15163-15166 (1991)]; and the T7 gene 10 protein peptide tag [Lutz-Freyermuth et al., *Proc. Natl. Acad. Sci. USA*, 87:6393-6397 (1990)].

In an alternative embodiment, the chimeric molecule may comprise a fusion of the anti-TAT antibody or TAT polypeptide with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of an anti-TAT antibody or TAT polypeptide in place of at least one variable region within an Ig molecule. In a particularly preferred embodiment, the immunoglobulin fusion includes the hinge, (CH$_2$ and CH$_3$, or the hinge, CH$_1$, CH$_2$ and CH$_3$ regions of an IgG1 molecule. For the production of immunoglobulin fusions see also U.S. Pat. No. 5,428,130 issued Jun. 27, 1995.

I. Preparation of Anti-TAT Antibodies and TAT Polypeptides

The description below relates primarily to production of anti-TAT antibodies and TAT polypeptides by culturing cells transformed or transfected with a vector containing anti-TAT antibody- and TAT polypeptide-encoding nucleic acid. It is, of course, contemplated that alternative methods, which are well known in the art, may be employed to prepare anti-TAT antibodies and TAT polypeptides. For instance, the appropriate amino acid sequence, or portions thereof, may be produced by direct peptide synthesis using solid-phase techniques [see, e.g., Stewart et al., *Solid-Phase Peptide Synthesis*, W. H. Freeman Co., San Francisco, Calif. (1969); Merrifield, *J. Am. Chem. Soc.*, 85:2149-2154 (1963)]. In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the anti-TAT antibody or TAT polypeptide may be chemically synthesized separately and combined using chemical or enzymatic methods to produce the desired anti-TAT antibody or TAT polypeptide.

1. Isolation of DNA Encoding Anti-TAT Antibody or TAT Polypeptide

DNA encoding anti-TAT antibody or TAT polypeptide may be obtained from a cDNA library prepared from tissue believed to possess the anti-TAT antibody or TAT polypeptide mRNA and to express it at a detectable level. Accordingly, human anti-TAT antibody or TAT polypeptide DNA can be conveniently obtained from a cDNA library prepared from human tissue. The anti-TAT antibody- or TAT polypeptide-encoding gene may also be obtained from a genomic library or by known synthetic procedures (e.g., automated nucleic acid synthesis).

Libraries can be screened with probes (such as oligonucleotides of at least about 20-80 bases) designed to identify the gene of interest or the protein encoded by it. Screening the cDNA or genomic library with the selected probe may be conducted using standard procedures, such as described in Sambrook et al., *Molecular Cloning: A Laboratory Manual* (New York: Cold Spring Harbor Laboratory Press, 1989). An alternative means to isolate the gene encoding anti-TAT antibody or TAT polypeptide is to use PCR methodology [Sambrook et al., supra; Dieffenbach et al., *PCR Primer: A Laboratory Manual* (Cold Spring Harbor Laboratory Press, 1995)].

Techniques for screening a cDNA library are well known in the art. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for anti-TAT antibody or TAT polypeptide production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in *Mammalian Cell Biotechnology: a Practical Approach* M. Butler, ed. (IRL Press, 1991) and Sambrook et al., supra.

Methods of eukaryotic cell transfection and prokaryotic cell transformation are known to the ordinarily skilled artisan, for example, CaCl$_2$, CaPO$_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., *Gene* 23:315 (1983) and WO 89/05859 published 29 Jun. 1989. For mammalian cells without such cell walls, the calcium phosphate precipitation method of Graham and van der Eb, *Virology,* 52:456-457 (1978) can be employed. General aspects of mammalian cell host system transfections have been described in U.S. Pat. No.4,399,216. Transformations into yeast are typically carried out according to the method of Van Solingen et al., *J. Bact.,* 130:946 (1977) and Hsiao et al., *Proc. Natl. Acad. Sci. (USA),* 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., *Methods in Enzymology,* 185:527-537 (1990) and Mansour et al., *Nature,* 336:348-352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27, 325) and K5 772 (ATCC 53, 635). Other suitable prokaryotic host cells include Enterobacteriaceae such as *Escherichia,* e.g., *E. coli, Enterobacter, Erwinia, Klebsiella, Proteus, Salmonella,* e.g., *Salmonella typhimurium, Serratia,* e.g., *Serratia marcescans,* and *Shigella,* as well as Bacilli such as *B. subtilis* and *B. licheniformis* (e.g., *B. licheniformis* 41P disclosed in DD 266, 710 published 12 Apr. 1989), *Pseudomonas* such as *P. aeruginosa,* and *Streptomyces.* These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3, *E. coli* W3110 strain 27C7 (ATCC 55,244), which has the complete genotype tonA ptr3 phoA E15 (argF-lac)169 degP ompT ka$^r$n, *E. coli* W3110 strain 37D6, which has the complete genotype tonA ptr3 phoA E15 (argF-lac)169 degP ompT rbs7 ilvG ka$^r$n, *E. coli* W3110 strain 40B4, which is strain 37D6 with a non-kanamycin resistant degP deletion mutation; and an *E. coli* strain having mutant periplasmic protease disclosed in U.S. Pat. No. 4,946,783 issued 7 Aug. 1990. Alternatively, in vitro methods of cloning, e.g., PCR or other nucleic acid polymerase reactions, are suitable.

Full length antibody, antibody fragments, and antibody fusion proteins can be produced in bacteria, in particular when glycosylation and Fc effector function are not needed, such as when the therapeutic antibody is conjugated to a cytotoxic agent (e.g., a toxin) and the immunoconjugate by itself shows effectiveness in tumor cell destruction. Full length antibodies have greater half life in circulation. Production in *E. coli* is faster and more cost efficient. For expression of antibody fragments and polypeptides in bacteria, see, e.g., U.S. Pat. No. 5,648,237 (Carter et. al.), U.S. Pat. No. 5,789, 199 (Joly et al.), and U.S. Pat. No. 5,840,523 (Simmons et al.) which describes translation initiation regio (TIR) and signal sequences for optimizing expression and secretion, these patents incorporated herein by reference. After expression, the antibody is isolated from the *E. coli* cell paste in a soluble fraction and can be purified through, e.g., a protein A or G column depending on the isotype. Final purification can be carried out similar to the process for purifying antibody expressed e.g., , in CHO cells.

In addition to prokaryotes, eukaryotic microbes such as filamentous fungi or yeast are suitable cloning or expression hosts for anti-TAT antibody- or TAT polypeptide-encoding vectors. *Saccharomyces cerevisiae* is a commonly used lower eukaryotic host microorganism. Others include *Schizosaccharomyces pombe* (Beach and Nurse, *Nature,* 290: 140 [1981]; EP 139, 383 published 2 May 1985); *Kluyveromyces* hosts (U.S. Pat. No. 4,943,529;Fleer et al., *Bio/Technology,*9: 968-975(1991))such as, e.g., *K. lactis* (MW98-8C, CBS683, CBS4574; Louvencourt et al., *J. Bacteriol.,* 154(2):737-742 [1983]), *K. fragilis* (ATCC 12,424), *K. bulgaricus* (ATCC 16,045), *K. wickeramii* (ATCC 24, 178), *K. waltii* (ATCC 56, 500), *K. drosophilarum* (ATCC 36, 906; Van den Berg et al., *Bio/Technology,* 8:135 (1990)), *K. thermotolerans,* and *K. marxianus; yarrowia* (EP402, 226); *Pichia pastoris* (EP 183, 070; Sreekrishna et al., *J. Basic Microbiol.,* 28:265-278 [1988]); *Candida; Trichoderma reesia* (EP 244, 234); *Neurospora crassa* (Case et al., *Proc. Natl. Acad. Sci. USA,* 76:5259-5263 [1979]); *Schwanniomyces* such as *Schwanniomyces occidentalis* (EP 394, 538 published 31 Oct. 1990); and filamentous fungi such as, e.g., *Neurospora, Penicillium, Tolypocladium* (WO 91/00357 published 10 Jan. 1991), and *Aspergillus* hosts such as *A. nidulans* (Ballance et al., *Biochem. Biophys. Res. Commun.,* 112:284-289 [1983]; Tilbum et al., *Gene,* 26:205-221 [1983]; Yelton et al., *Proc. Natl. Acad. Sci. USA,* 81: 1470-1474 [1984]), and *A. niger* (Kelly and Hynes, *EMBO J.,* 4:475-479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis,* and *Rhodotorula.* A list of specific species that are exemplary of this class of yeasts may be found in C. Anthony, *The Biochemistry of Methylotrophs,* 269 (1982).

Suitable host cells for the expression of glycosylated anti-TAT antibody or TAT polypeptide are derived from multicellular organisms. Examples of invertebrate cells include insect cells such as Drosophila S2 and Spodoptera Sf9, as well as plant cells, such as cell cultures of cotton, corn, potato, soybean, petunia, tomato, and tobacco. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., *J. Gen Virol.* 36:59 (1977)); baby hamster kidney cells (BHK, ATCC CCL 10); Chinese hamster ovary cells/-DHFR (CHO, Urlaub et al., *Proc. Natl. Acad. Sci. USA* 77:4216 (1980)); mouse sertoli cells (TM4, Mather, *Biol. Reprod.* 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., *Annals N.Y. Acad. Sci.* 383:44-68 (1982)); MRC 5 cells; FS4 cells; and a human hepatoma line (Hep G2).

Host cells are transformed with the above-described expression or cloning vectors for anti-TAT antibody or TAT polypeptide production and cultured in conventional nutrient media modified as appropriate for inducing promoters, selecting transformants, or amplifying the genes encoding the desired sequences.

3. Selection and Use of a Replicable Vector

The nucleic acid (e.g., cDNA or genomic DNA) encoding anti-TAT antibody or TAT polypeptide may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The TAT may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the anti-TAT antibody- or TAT polypeptide-encoding DNA that is inserted into the vector. The signal sequence may be a prokaryotic signal sequence selected, for example, from the group of the alkaline phosphatase, penicillinase, lpp, or heat-stable enterotoxin II leaders. For yeast secretion the signal sequence may be, e.g., the yeast invertase leader, alpha factor leader (including *Saccharomyces* and *Kluyveromyces* α-factor leaders, the latter described in U.S. Pat. No. 5,010,182), or acid phosphatase leader, the *C. albicans* glucoamylase leader (EP 362, 179 published 4 Apr. 1990), or the signal described in WO 90/13646 published 15 Nov. 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for *Bacilli*.

An example of suitable selectable markers for mammalian cells are those that enable the identification of cells competent to take up the anti-TAT antibody- or TAT polypeptide-encoding nucleic acid, such as DHFR or thymidine kinase. An appropriate host cell when wild-type DHFR is employed is the CHO cell line deficient in DHFR activity, prepared and propagated as described by Urlaub et al., *Proc. Natl. Acad. Sci. USA*, 77:4216 (1980). A suitable selection gene for use in yeast is the rp1 gene present in the yeast plasmid YRp7 [Stinchcomb et al., *Nature*, 282:39 (1979); Kingsman et al., *Gene*, 7:141 (1979); Tschemper et al., *Gene*, 10:157 (1980)] trp1 gene provides a selection marker for a mutant strain of yeast lacking the ability to grow in tryptophan, for example, ATCC No. 44076 or PEP4-1 [Jones, Genetics, 85:12 (1977)].

Expression and cloning vectors usually contain a promoter operably linked to the anti-TAT antibody- or TAT polypeptide-encoding nucleic acid sequence to direct mRNA synthesis. Promoters recognized by a variety of potential host cells are well known. Promoters suitable for use with prokaryotic hosts include the β-lactamase and lactose promoter systems [Chang et al., *Nature*, 275:615 (1978); Goeddel et al., *Nature*, 281:544 (1979)], alkaline phosphatase, a tryptophan (trp) promoter system [Goeddel, *Nucleic Acids Res.*, 8:4057 (1980); EP 36, 776], and hybrid promoters such as the tac promoter [deBoer et al., *Proc. Natl. Acad. Sci. USA*, 80:21-25 (1983)]. Promoters for use in bacterial systems also will contain a Shine-Dalgarno (S.D.) sequence operably linked to the DNA encoding anti-TAT antibody or TAT polypeptide.

Examples of suitable promoting sequences for use with yeast hosts include the promoters for 3-phosphoglycerate kinase [Hitzeman et al., *J. Biol. Chem.*, 255:2073 (1980)] or other glycolytic enzymes [Hess et al., *J. Adv. Enzyme Reg.*, 7:149 (1968); Holland, *Biochemistry*, 17:4900 (1978)], such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73, 657.

Anti-TAT antibody or TAT polypeptide transcription from vectors in mammalian host cells is controlled, for example, by promoters obtained from the genomes of viruses such as polyoma virus, fowipox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the anti-TAT antibody or TAT polypeptide by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers.

The enhancer may be spliced into the vector at a position 5' or 3' to the anti-TAT antibody or TAT polypeptide coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding anti-TAT antibody or TAT polypeptide.

Still other methods, vectors, and host cells suitable for adaptation to the synthesis of anti-TAT antibody or TAT polypeptide in recombinant vertebrate cell culture are described in Gething et al., *Nature,* 293:620-625 (1981); Mantei et al., *Nature,* 281:40-46 (1979); EP 117,060; and EP 117,058.

4. Culturing the Host Cells

The host cells used to produce the anti-TAT antibody or TAT polypeptide of this invention may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., *Meth. Enz.* 58:44 (1979), Barnes et al., *Anal. Biochem.* 102: 255 (1980), U.S. Pat. Nos. 4,767,704; 4,657,866; 4,927,762; 4,560,655; or 5,122,469; WO 90/03430; WO 87/00195; or U.S. Patent Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

5. Detecting Gene Amplification/Expression

Gene amplification and/or expression may be measured in a sample directly, for example, by conventional Southern blotting, Northern blotting to quantitate the transcription of mRNA [Thomas, *Proc. Natl. Acad. Sci. USA,* 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence TAT polypeptide or against a synthetic peptide based on the DNA sequences provided herein or against exogenous sequence fused to TAT DNA and encoding a specific antibody epitope.

6. Purification of Anti-TAT Antibody and TAT Polypeptide

Forms of anti-TAT antibody and TAT polypeptide may be recovered from culture medium or from host cell lysates. If membrane-bound, it can be released from the membrane using a suitable detergent solution (e.g. Triton-X100) or by enzymatic cleavage. Cells employed in expression of anti-TAT antibody and TAT polypeptide can be disrupted by various physical or chemical means, such as freeze-thaw cycling, sonication, mechanical disruption, or cell lysing agents.

It may be desired to purify anti-TAT antibody and TAT polypeptide from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms of the anti-TAT antibody and TAT polypeptide. Various methods of protein purification may be employed and such methods are known in the art and described for example in Deutscher, *Methods in Enzymology,* 182 (1990); Scopes, *Protein Purification: Principles and Practice,* Springer-Verlag, New York (1982). The purification step(s) selected will depend, for example, on the nature of the production process used and the particular anti-TAT antibody or TAT polypeptide produced.

When using recombinant techniques, the antibody can be produced intracellularly, in the periplasmic space, or directly secreted into the medium. If the antibody is produced intracellularly, as a first step, the particulate debris, either host cells or lysed fragments, are removed, for example, by centrifugation or ultrafiltration. Carter et al., *Bio/Technology* 10: 163-167 (1992) describe a procedure for isolating antibodies which are secreted to the periplasmic space of *E. coli.* Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody composition prepared from the cells can be purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human γ1, γ2 or γ4 heavy chains (Lindmark et al., *J. Immunol. Meth.* 62:1-13 (1983)). Protein G is recommended for all mouse isotypes and for humanγ3 (Guss et al., *EMBO J.*5:15671575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose.

Where the antibody comprises a $C_H3$ domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the antibody of interest and contaminants may be subjected to low pH hydrophobic interaction chromatography using an elution buffer at a pH between about 2.5-4.5, preferably performed at low salt concentrations (e.g., from about 0-0.25M salt).

J. Pharmaceutical Formulations

Therapeutic formulations of the anti-TAT antibodies, TAT binding oligopeptides, TAT binding organic molecules and/or TAT polypeptides used in accordance with the present invention are prepared for storage by mixing the antibody, polypeptide, oligopeptide or organic molecule having the desired degree of purity with optional pharmaceutically acceptable carriers, excipients or stabilizers Remington's Pharmaceutical Sciences 16th edition, Osol, A. Ed. (1980)), in the form of lyophilized formulations or aqueous solutions. Acceptable carriers, excipients, or stabilizers are nontoxic to recipients at the dosages and concentrations employed, and include buffers such as acetate, Tris, phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; tonicifiers such as trehalose and sodium chloride; sugars such as sucrose, mannitol, trehalose or sorbitol; surfactant such as polysorbate; salt-forming counter-ions such as sodium; metal complexes (e.g., Zn-protein complexes); and/or non-ionic surfactants such as TWEEN®, PLURONICS® or polyethylene glycol (PEG). The antibody preferably comprises the antibody at a concentration of between 5-200 mg/ml, preferably between 10-100 mg/ml.

The formulations herein may also contain more than one active compound as necessary for the particular indication being treated, preferably those with complementary activities that do not adversely affect each other. For example, in addition to an anti-TAT antibody, TAT binding oligopeptide, or TAT binding organic molecule, it may be desirable to include in the one formulation, an additional antibody, e.g., a second anti-TAT antibody which binds a different epitope on the TAT polypeptide, or an antibody to some other target such as a growth factor that affects the growth of the particular cancer. Alternatively, or additionally, the composition may further comprise achemotherapeutic agent, cytotoxic agent, cytokine, growth inhibitory agent, anti-hormonal agent, and/or cardioprotectant. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences, 16th edition, Osol, A. Ed. (1980).

Sustained-release preparations may be prepared. Suitable examples of sustained-release preparations include semi-permeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT® (injectable microspheres composed of lactic acid-glycolic acid copolymer and leuprolide acetate), and poly-D-(−)-3-hydroxybutyric acid.

The formulations to be used for in vivo administration must be sterile. This is readily accomplished by filtration through sterile filtration membranes.

K. Diagnosis and Treatment with Anti-TAT Antibodies, TAT Binding Oligopeptides and TAT Binding Organic Molecules To determine TAT expression in the cancer, various diagnostic assays are available. In one embodiment, TAT polypeptide overexpression may be analyzed by immunohistochemistry (IHC). Parrafin embedded tissue sections from a tumor biopsy may be subjected to the IHC assay and accorded a TAT protein staining intensity criteria as follows:

Score 0—no staining is observed or membrane staining is observed in less than 10% of tumor cells.

Score 1+—a faint/barely perceptible membrane staining is detected in more than 10% of the tumor cells.

The cells are only stained in part of their membrane.

Score 2+—a weak to moderate complete membrane staining is observed in more than 10% of the tumor cells.

Score 3+—a moderate to strong complete membrane staining is observed in more than 10% of the tumor cells.

Those tumors with 0 or 1+ scores for TAT polypeptide expression may be characterized as not overexpressing TAT, whereas those tumors with 2+ or 3+ scores may be characterized as overexpressing TAT.

Alternatively, or additionally, FISH assays such as the INFORM® (sold by Ventana, Ariz.) or PATHVISION® (Vysis, Ill.) may be carried out on formalin-fixed, paraffin-embedded tumor tissue to determine the extent (if any) of TAT overexpression in the tumor.

TAT overexpression or amplification may be evaluated using an in vivo diagnostic assay, e.g., by administering a molecule (such as an antibody, oligopeptide or organic molecule) which binds the molecule to be detected and is tagged with a detectable label (e.g., a radioactive isotope or a fluorescent label) and externally scanning the patient for localization of the label.

As described above, the anti-TAT antibodies, oligopeptides and organic molecules of the invention have various non-therapeutic applications. The anti-TAT antibodies, oligopeptides and organic molecules of the present invention can be useful for diagnosis and staging of TAT polypeptide-expressing cancers (e.g., in radioimaging). The antibodies, oligopeptides and organic molecules are also useful for purification or immunoprecipitation of TAT polypeptide from cells, for detection and quantitation of TAT polypeptide in vitro, e.g., in an ELISA or a Western blot, to kill and eliminate TAT-expressing cells from a population of mixed cells as a step in the purification of other cells.

Currently, depending on the stage of the cancer, cancer treatment involves one or a combination of the following therapies: surgery to remove the cancerous tissue, radiation therapy, and chemotherapy. Anti-TAT antibody, oligopeptide or organic molecule therapy may be especially desirable in elderly patients who do not tolerate the toxicity and side effects of chemotherapy well and in metastatic disease where radiation therapy has limited usefulness. The tumor targeting anti-TAT antibodies, oligopeptides and organic molecules of the invention are useful to alleviate TAT-expressing cancers upon initial diagnosis of the disease or during relapse. For therapeutic applications, the anti-TAT antibody, oligopeptide or organic molecule can be used alone, or in combination therapy with, e.g., hormones, antiangiogens, or radiolabelled compounds, or with surgery, cryotherapy, and/or radiotherapy. Anti-TAT antibody, oligopeptide or organic molecule treatment can be administered in conjunction with other forms of conventional therapy, either consecutively with, pre- or post-conventional therapy. Chemotherapeutic drugs such as TAXOTERE® (docetaxel), TAXOL® (palictaxel), estramustine and mitoxantrone are used in treating cancer, in particular, in good risk patients. In the present method of the invention for treating or alleviating cancer, the cancer patient can be administered anti-TAT antibody, oligopeptide or organic molecule in conjuction with treatment with the one or more of the preceding chemotherapeutic agents. In particular, combination therapy with palictaxel and modified derivatives (see, e.g., EP0600517) is contemplated. The anti-TAT antibody, oligopeptide or organic molecule will be administered with a therapeutically effective dose of the chemotherapeutic agent. In another embodiment, the anti-TAT antibody, oligopeptide or organic molecule is administered in conjunction with chemotherapy to enhance the activity and efficacy of the chemotherapeutic agent, e.g., paclitaxel. The Physicians' Desk Reference (PDR) discloses dosages of these agents that have been used in treatment of various cancers. The dosing regimen and dosages of these aforementioned chemotherapeutic drugs that are therapeutically effective will depend on the particular cancer being treated, the extent of the disease and other factors familiar to the physician of skill in the art and can be determined by the physician.

In one particular embodiment, a conjugate comprising an anti-TAT antibody, oligopeptide or organic molecule conjugated with a cytotoxic agent is administered to the patient. Preferably, the immunoconjugate bound to the TAT protein is internalized by the cell, resulting in increased therapeutic efficacy of the immunoconjugate in killing the cancer cell to which it binds. In a preferred embodiment, the cytotoxic agent targets or interferes with the nucleic acid in the cancer cell. Examples of such cytotoxic agents are described above and include maytansinoids, calicheamicins, ribonucleases and DNA endonucleases.

The anti-TAT antibodies, oligopeptides, organic molecules or toxin conjugates thereof are administered to a human patient, in accord with known methods, such as intravenous administration, e.g., , as a bolus or by continuous infusion over a period of time, by intramuscular, intraperitoneal, intracerobrospinal, subcutaneous, intra-articular, intrasynovial, intrathecal, oral, topical, or inhalation routes. Intravenous or subcutaneous administration of the antibody, oligopeptide or organic molecule is preferred.

Other therapeutic regimens may be combined with the administration of the anti-TAT antibody, oligopeptide or organic molecule. The combined administration includes co-administration, using separate formulations or a single pharmaceutical formulation, and consecutive administration in either order, wherein preferably there is a time period while both (or all) active agents simultaneously exert their biological activities. Preferably such combined therapy results in a synergistic therapeutic effect.

It may also be desirable to combine administration of the anti-TAT antibody or antibodies, oligopeptides or organic molecules, with administration of an antibody directed against another tumor antigen associated with the particular cancer.

In another embodiment, the therapeutic treatment methods of the present invention involves the combined administration of an anti-TAT antibody (or antibodies), oligopeptides or organic molecules and one or more chemotherapeutic agents or growth inhibitory agents, including co-administration of cocktails of different chemotherapeutic agents. Chemotherapeutic agents include estramustine phosphate, prednimustine, cisplatin, 5-fluorouracil, melphalan, cyclophosphamide, hydroxyurea and hydroxyureataxanes (such as paclitaxel and doxetaxel) and/or anthracycline antibiotics. Preparation and dosing schedules for such chemotherapeutic agents may be used according to manufacturers' instructions or as determined empirically by the skilled practitioner. Preparation and dosing schedules for such chemotherapy are also described in Chemotherapy Service Ed., M. C. Perry, Williams & Wilkins, Baltimore, Md. (1992).

The antibody, oligopeptide or organic molecule may be combined with an anti-hormonal compound; e.g., an anti-estrogen compound such as tamoxifen; an anti-progesterone such as onapristone (see, EP 616 812); or an anti-androgen such as flutamide, in dosages known for such molecules. Where the cancer to be treated is androgen independent cancer, the patient may previously have been subjected to anti-androgen therapy and, after the cancer becomes androgen independent, the anti-TAT antibody, oligopeptide or organic molecule (and optionally other agents as described herein) may be administered to the patient.

Sometimes, it may be beneficial to also co-administer a cardioprotectant (to prevent or reduce myocardial dysfunction associated with the therapy) or one or more cytokines to the patient. In addition to the above therapeutic regimes, the patient may be subjected to surgical removal of cancer cells and/or radiation therapy, before, simultaneously with, or post antibody, oligopeptide or organic molecule therapy. Suitable dosages for any of the above co-administered agents are those presently used and may be lowered due to the combined action (synergy) of the agent and anti-TAT antibody, oligopeptide or organic molecule.

For the prevention or treatment of disease, the dosage and mode of administration will be chosen by the physician according to known criteria. The appropriate dosage of antibody, oligopeptide or organic molecule will depend on the type of disease to be treated, as defined above, the severity and course of the disease, whether the antibody, oligopeptide or organic molecule is administered for preventive or therapeutic purposes, previous therapy, the patient's clinical history and response to the antibody, oligopeptide or organic molecule, and the discretion of the attending physician. The antibody, oligopeptide or organic molecule is suitably administered to the patient at one time or over a series of treatments. Preferably, the antibody, oligopeptide or organic molecule is administered by intravenous infusion or by subcutaneous injections. Depending on the type and severity of the disease, about 1 µg/kg to about 50 mg/kg body weight (e.g., about 0.1-15 mg/kg/dose) of antibody can be an initial candidate dosage for administration to the patient, whether, for example, by one or more separate administrations, or by continuous infusion. A dosing regimen can comprise administering an initial loading dose of about 4 mg/kg, followed by a weekly maintenance dose of about 2 mg/kg of the anti-TAT antibody. However, other dosage regimens may be useful. A typical daily dosage might range from about µg/kg to 100 mg/kg or more, depending on the factors mentioned above. For repeated administrations over several days or longer, depending on the condition, the treatment is sustained until a desired suppression of disease symptoms occurs. The progress of this therapy can be readily monitored by conventional methods and assays and based on criteria known to the physician or other persons of skill in the art.

Aside from administration of the antibody protein to the patient, the present application contemplates administration of the antibody by gene therapy. Such administration of nucleic acid encoding the antibody is encompassed by the expression "administering a therapeutically effective amount of an antibody". See, for example, WO96/07321 published Mar. 14, 1996 concerning the use of gene therapy to generate intracellular antibodies.

There are two major approaches to getting the nucleic acid (optionally contained in a vector) into the patient's cells; in vivo and ex vivo. Forin vivo delivery the nucleic acid is injected directly into the patient, usually at the site where the antibody is required. For ex vivo treatment, the patient's cells are removed, the nucleic acid is introduced into these isolated cells and the modified cells are administered to the patient either directly or, for example, encapsulated within porous membranes which are implanted into the patient (see, e.g., U.S. Pat. Nos. 4,892,538 and 5,283,187). There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. A commonly used vector for ex vivo delivery of the gene is a retroviral vector.

The currently preferred in vivo nucleic acid transfer techniques include transfection with viral vectors (such as adenovirus, Herpes simplex I virus, or adeno-associated virus) and lipid-based systems (useful lipids for lipid-mediated transfer of the gene are DOTMA, DOPE and DC-Chol, for example). For review of the currently known gene marking and gene therapy protocols see Anderson et al., *Science* 256:808-813 (1992). See also WO 93/25673 and the references cited therein.

The anti-TAT antibodies of the invention can be in the different forms encompassed by the definition of "antibody" herein. Thus, the antibodies include full length or intact antibody, antibody fragments, native sequence antibody or amino acid variants, humanized, chimeric or fusion antibodies, immunoconjugates, and functional fragments thereof. In fusion antibodies an antibody sequence is fused to a heterologous polypeptide sequence. The antibodies can be modified in the Fc region to provide desired effector functions. As discussed in more detail in the sections herein, with the appropriate Fc regions, the naked antibody bound on the cell surface can induce cytotoxicity, e.g., via antibody-dependent cellular cytotoxicity (ADCC) or by recruiting complement in complement dependent cytotoxicity, or some other mechanism. Alternatively, where it is desirable to eliminate or reduce effector function, so as to minimize side effects or therapeutic complications, certain other Fc regions may be used.

In one embodiment, the antibody competes for binding or bind substantially to, the same epitope as the antibodies of the invention. Antibodies having the biological characteristics of the present anti-TAT antibodies of the invention are also contemplated, specifically including the in vivo tumor targeting and any cell proliferation inhibition or cytotoxic characteristics.

Methods of producing the above antibodies are described in detail herein.

The present anti-TAT antibodies, oligopeptides and organic molecules are useful for treating a TAT-expressing cancer or alleviating one or more symptoms of the cancer in a mammal. Such a cancer includes prostate cancer, cancer of the urinary tract, lung cancer, breast cancer, colon cancer and ovarian cancer, more specifically, prostate adenocarcinoma, renal cell carcinomas, colorectal adenocarcinomas, lung adenocarcinomas, lung squamous cell carcinomas, and pleural mesothelioma. The cancers encompass metastatic cancers of any of the preceding. The antibody, oligopeptide or organic molecule is able to bind to at least a portion of the cancer cells that express TAT polypeptide in the mammal. In a preferred embodiment, the antibody, oligopeptide or organic molecule is effective to destroy or kill TAT-expressing tumor cells or inhibit the growth of such tumor cells, in vitro or in vivo, upon binding to TAT polypeptide on the cell. Such an antibody includes a naked anti-TAT antibody (not conjugated to any agent). Naked antibodies that have cytotoxic or cell growth inhibition properties can be further harnessed with a cytotoxic agent to render them even more potent in tumor cell destruction. Cytotoxic properties can be conferred to an anti-TAT antibody by, e.g., conjugating the antibody with a cytotoxic agent, to form an immunoconjugate as described herein. The cytotoxic agent or a growth inhibitory agent is preferably a small molecule. Toxins such as calicheamicin or a maytansinoid and analogs or derivatives thereof, are preferable.

The invention provides a composition comprising an anti-TAT antibody, oligopeptide or organic molecule of the invention, and a carrier. For the purposes of treating cancer, compositions can be administered to the patient in need of such treatment, wherein the composition can comprise one or more anti-TAT antibodies present as an immunoconjugate or as the naked antibody. In a further embodiment, the compositions can comprise these antibodies, oligopeptides or organic molecules in combination with other therapeutic agents such as cytotoxic or growth inhibitory agents, including chemotherapeutic agents. The invention also provides formulations comprising an anti-TAT antibody, oligopeptide or organic molecule of the invention, and a carrier. In one embodiment, the formulation is a therapeutic formulation comprising a pharmaceutically acceptable carrier.

Another aspect of the invention is isolated nucleic acids encoding the anti-TAT antibodies. Nucleic acids encoding both the H and L chains and especially the hypervariable region residues, chains which encode the native sequence antibody as well as variants, modifications and humanized versions of the antibody, are encompassed.

The invention also provides methods useful for treating a TAT polypeptide-expressing cancer or alleviating one or more symptoms of the cancer in a mammal, comprising administering a therapeutically effective amount of an anti-TAT antibody, oligopeptide or organic molecule to the mammal. The antibody, oligopeptide or organic molecule therapeutic compositions can be administered short term (acute) or chronic, or intermittent as directed by physician. Also provided are methods of inhibiting the growth of, and killing a TAT polypeptide-expressing cell.

The invention also provides kits and articles of manufacture comprising at least one anti-TAT antibody, oligopeptide or organic molecule. Kits containing anti-TAT antibodies, oligopeptides or organic molecules find use, e.g., for TAT cell killing assays, for purification or immunoprecipitation of TAT polypeptide from cells. For example, for isolation and purification of TAT, the kit can contain an anti-TAT antibody, oligopeptide or organic molecule coupled to beads (e.g., sepharose beads). Kits can be provided which contain the antibodies, oligopeptides or organic molecules for detection and quantitation of TAT in vitro, e.g., in an ELISA or a Western blot. Such antibody, oligopeptide or organic molecule useful for detection may be provided with a label such as a fluorescent or radiolabel.

L. Articles of Manufacture and Kits

Another embodiment of the invention is an article of manufacture containing materials useful for the treatment of anti-TAT expressing cancer. The article of manufacture comprises a container and a label or package insert on or associated with the container. Suitable containers include, for example, bottles, vials, syringes, etc. The containers may be formed from a variety of materials such as glass or plastic. The container holds a composition which is effective for treating the cancer condition and may have a sterile access port (for example the container may be an intravenous solution bag or a vial having a stopper pierceable by a hypodermic injection needle). At least one active agent in the composition is an anti-TAT antibody, oligopeptide or organic molecule of the invention. The label or package insert indicates that the composition is used for treating cancer. The label or package insert will further comprise instructions for administering the antibody, oligopeptide or organic molecule composition to the cancer patient. Additionally, the article of manufacture may further comprise a second container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

Kits are also provided that are useful for various purposes, e.g., for TAT-expressing cell killing assays, for purification or immunoprecipitation of TAT polypeptide from cells. For isolation and purification of TAT polypeptide, the kit can contain an anti-TAT antibody, oligopeptide or organic molecule coupled to beads (e.g., sepharose beads). Kits can be provided which contain the antibodies, oligopeptides or organic molecules for detection and quantitation of TAT polypeptide in vitro, e.g., in an ELISA or a Western blot. As with the article of manufacture, the kit comprises a container and a label or package insert on or associated with the container. The container holds a composition comprising at least one anti-TAT antibody, oligopeptide or organic molecule of the invention. Additional containers may be included that contain, e.g., diluents and buffers, control antibodies.

The label or package insert may provide a description of the composition as well as instructions for the intended in vitro or diagnostic use.

M. Uses for TAT Polypeptides and TAT-Polypeptide Encoding Nucleic Acids

Nucleotide sequences (or their complement) encoding TAT polypeptides have various applications in the art of molecular biology, including uses as hybridization probes, in chromosome and gene mapping and in the generation of anti-sense RNA and DNA probes. TAT-encoding nucleic acid will also be useful for the preparation of TAT polypeptides by the recombinant techniques described herein, wherein those TAT polypeptides may find use, for example, in the preparation of anti-TAT antibodies as described herein.

The full-length native sequence TAT gene, or portions thereof, may be used as hybridization probes for a cDNA library to isolate the full-length TAT cDNA or to isolate still other cDNAs (for instance, those encoding naturally-occurring variants of TAT or TAT from other species) which have a desired sequence identity to the native TAT sequence disclosed herein. Optionally, the length of the probes will be about 20 to about 50 bases. The hybridization probes may be derived from at least partially novel regions of the full length native nucleotide sequence wherein those regions may be determined without undue experimentation or from genomic sequences including promoters, enhancer elements and introns of native sequence TAT. By way of example, a screening method will comprise isolating the coding region of the TAT gene using the known DNA sequence to synthesize a selected probe of about 40 bases. Hybridization probes may be labeled by a variety of labels, including radionucleotides such as $^{32}P$ or $^{35}S$, or enzymatic labels such as alkaline phosphatase coupled to the probe via avidin/biotin coupling systems. Labeled probes having a sequence complementary to that of the TAT gene of the present invention can be used to screen libraries of human cDNA, genomic DNA or mRNA to determine which members of such libraries the probe hybridizes to. Hybridization techniques are described in further detail in the Examples below. Any EST sequences disclosed in the present application may similarly be employed as probes, using the methods disclosed herein.

Other useful fragments of the TAT-encoding nucleic acids include antisense or sense oligonucleotides comprising a singe-stranded nucleic acid sequence (either RNA or DNA) capable of binding to target TAT mRNA (sense) or TAT DNA (antisense) sequences. Antisense or sense oligonucleotides, according to the present invention, comprise a fragment of the coding region of TAT DNA. Such a fragment generally comprises at least about 14 nucleotides, preferably from about 14 to 30 nucleotides. The ability to derive an antisense or a sense oligonucleotide, based upon a cDNA sequence encoding a given protein is described in, for example, Stein and Cohen (*Cancer Res.* 48:2659, 1988) and van der Krol et al. (*BioTechniques* 6:958, 1988).

Binding of antisense or sense oligonucleotides to target nucleic acid sequences results in the formation of duplexes that block transcription or translation of the target sequence by one of several means, including enhanced degradation of the duplexes, premature termination of transcription or translation, or by other means. Such methods are encompassed by the present invention. The antisense oligonucleotides thus may be used to block expression of TAT proteins, wherein those TAT proteins may play a role in the induction of cancer in mammals. Antisense or sense oligonucleotides further comprise oligonucleotides having modified sugar-phosphodiester backbones (or other sugar linkages, such as those described in WO 91/06629) and wherein such sugar linkages are resistant to endogenous nucleases. Such oligonucleotides with resistant sugar linkages are stable in vivo (i.e., capable of resisting enzymatic degradation) but retain sequence specificity to be able to bind to target nucleotide sequences.

Preferred intragenic sites for antisense binding include the region incorporating the translation initiation/start codon (5'-AUG/5'-ATG) or termination/stop codon (5'-UAA, 5'-UAG and 5-UGA/5'-TAA, 5'-TAG and 5'-TGA) of the open reading frame (ORF) of the gene. These regions refer to a portion of the mRNA or gene that encompasses from about 25 to about 50 contiguous nucleotides in either direction (i.e., 5' or 3') from a translation initiation or termination codon. Other preferred regions for antisense binding include: introns; exons; intron-exon junctions; the open reading frame (ORF) or "coding region," which is the region between the translation initiation codon and the translation termination codon; the 5' cap of an mRNA which comprises an N7-methylated guanosine residue joined to the 5'-most residue of the mRNA via a 5'-5' triphosphate linkage and includes 5' cap structure itself as well as the first 50 nucleotides adjacent to the cap; the 5' untranslated region (5'UTR), the portion of an mRNA in the 5' direction from the translation initiation codon, and thus including nucleotides between the 5' cap site and the translation initiation codon of an mRNA or corresponding nucleotides on the gene; and the 3' untranslated region (3'UTR), the portion of an mRNA in the 3' direction from the translation termination codon, and thus including nucleotides between the translation termination codon and 3' end of an mRNA or corresponding nucleotides on the gene.

Specific examples of preferred antisense compounds useful for inhibiting expression of TAT proteins include oligonucleotides containing modified backbones or non-natural internucleoside linkages. Oligonucleotides having modified backbones include those that retain a phosphorus atom in the backbone and those that do not have a phosphorus atom in the backbone. For the purposes of this specification, and as sometimes referenced in the art, modified oligonucleotides that do not have a phosphorus atom in their internucleoside backbone can also be considered to be oligonucleosides. Preferred modified oligonucleotide backbones include, for example, phosphorothioates, chiral phosphorothioates, phosphorodithioates, phosphotriesters, aminoalkylphosphotri-esters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, selenophosphates and borano-phosphates having normal 3'-5' linkages, 2'-5' linked analogs of these, and those having inverted polarity wherein one or more internucleotide linkages is a 3' to 3', 5' to 5' or 2' to 2' linkage. Preferred oligonucleotides having inverted polarity comprise a single 3' to 3' linkage at the 3'-most internucleotide linkage i.e. a single inverted nucleoside residue which may be a basic (the nucleobase is missing or has a hydroxyl group in place thereof). Various salts, mixed salts and free acid forms are also included. Representative United States patents that teach the preparation of phosphorus-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; 5,194,599; 5,565,555; 5,527,899; 5,721,218; 5,672,697 and 5,625,050, each of which is herein incorporated by reference.

Preferred modified oligonucleotide backbones that do not include a phosphorus atom therein have backbones that are formed by short chain alkyl orcycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; riboacetyl backbones; alkene containing backbones; sulfamate backbones; methyleneimino and methylenehydrazino backbones; sulfonate and sulfonamide backbones; amide backbones; and others having mixed N, O, S and $CH_2$ component parts. Representative United States patents that teach the preparation of such oligonucleosides include, but are not limited to, U.S. Pat. Nos. 5,034,506; 5,166,315; 5,185,444; 5,214,134; 5,216,141; 5,235,033; 5,264,562; 5,264,564; 5,405, 938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; 5,792,608; 5,646,269 and 5,677,439, each of which is herein incorporated by reference.

In other preferred antisense oligonucleotides, both the sugar and the internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, in particular an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., Science, 1991, 254, 1497-1500.

Preferred antisense oligonucleotides incorporate phosphorothioate backbones and/or heteroatom backbones, and in particular —$CH_2$—NH—O—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —O—N($CH_3$)—$CH_2$—$CH_2$— [wherein the native phosphodiester backbone is represented as —O—P—O—$CH_2$—] described in the above referenced U.S. Pat. No. 5,489,677, and the amide backbones of the above referenced U.S. Pat. No. 5,602,240. Also preferred are antisense oligonucleotides having morpholino backbone structures of the above-referenced U.S. Pat. No. 5,034,506.

Modified oligonucleotides may also contain one or more substituted sugar moieties. Preferred oligonucleotides comprise one of the following at the 2' position: OH; F; O-alkyl, S-alkyl, or N-alkyl; O-alkenyl, S-alkeynyl, or N-alkenyl; O-alkynyl, S-alkynyl or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Particularly preferred are O[$(CH_2)_nO]_mCH_3$, O$(CH_2)_nOCH_3$, O$(CH_2)_nNH_2$, O$(CH_2)_nCH_3$, O$(CH_2)_nONH_2$, and O$(CH_2ON$ [$(CH_2)_nCH_3)]_2$, where n and m are from 1 to about 10. Other preferred antisense oligonucleotides comprise one of the following at the 2' position: $C_1$ to $C_{10}$ lower alkyl, substituted lower alkyl, alkenyl, alkynyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. A preferred modification includes 2'-methoxyethoxy (2'-O—$CH_2CH_2OCH_3$, also known as 2'-O-(2-methoxyethyl) or 2'-MOE) (Martin et al., Helv. Chim. Acta, 1995, 78, 486-504) i.e., an alkoxyalkoxy group. A further preferred modification includes 2'-dimethylaminooxyethoxy, i.e., a O(CH$_2$)$_2$ON(CH$_3$)$_2$ group, also known as 2'-DMAOE, as described in examples hereinbelow, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$).

A further preferred modification includes Locked Nucleic Acids (LNAs) in which the 2'-hydroxyl group is linked to the 3' or 4' carbon atom of the sugar ring thereby forming a bicyclic sugar moiety. The linkage is preferably a methelyne (—CH$_2$—)$_n$ group bridging the 2' oxygen atom and the 4' carbon atom wherein n is 1 or 2. LNAs and preparation thereof are described in WO 98/39352 and WO 99/14226.

Other preferred modifications include 2'-methoxy(2'-O—CH$_3$), 2'-aminopropoxy(2'-OCH$_2$CH$_2$CH$_2$NH$_2$), 2'-allyl(2'-CH$_2$—CH═CH$_2$), 2'-O-allyl (2'-O—CH$_2$—CH═CH$_2$) and 2'-fluoro (2'-F). The 2'-modification may be in the arabino (up) position or ribo (down) position. A preferred 2'-arabino modification is 2'-F. Similar modifications may also be made at other positions on the oligonucleotide, particularly the 3' position of the sugar on the 3' terminal nucleotide or in 2'-5' linked oligonucleotides and the 5' position of 5' terminal nucleotide. Oligonucleotides may also have sugar mimetics such as cyclobutyl moieties in place of the pentofuranosyl sugar. Representative United States patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; 5,792,747; and 5,700,920, each of which is herein incorporated by reference in its entirety.

Oligonucleotides may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl(—C≡C—CH$_3$ or —CH$_2$—C≡CH) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. Further modified nucleobases include tricyclic pyrimidines such as phenoxazine cytidine(1H-pyrimido[5,4-b][1,4]benzoxazin-2(3H)-one), phenothiazine cytidine (1H-pyrimido[5,4-b][1,4]benzothiazin-2(3H)-one), G-clamps such as a substituted phenoxazine cytidine (e.g. 9-(2-aminoethoxy)-H-pyrimido[5, 4-b][1,4]benzoxazin-2 (3H)-one), carbazole cytidine (2H-pyrimido[4,5-b]indol-2-one), pyridoindole cytidine (H-pyrido[3',2':4,5]pyrrolo[2,3-d]pyrimidin-2-one). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in U.S. Pat. No. 3,687,808, those disclosed in The Concise Encyclopedia Of Polymer Science And Engineering, pages 858-859, Kroschwitz, J. I., ed. John Wiley & Sons, 1990, and those disclosed by Englisch et al., Angewandte Chemie, International Edition, 1991, 30, 613. Certain of these nucleobases are particularly useful for increasing the binding affinity of the oligomeric compounds of the invention. These include 5-substituted pyrimidines, 6-azapyrimidines and N-2, N-6 and O-6 substituted purin including 2-aminopropyladenine, 5-propynyluracil and 5-propynylcytosine. 5-methylcytosine substitutions have been shown to increase nucleic acid duplex stability by 0.6-1.2. degree. C. (Sanghvi et al, Antisense Research and Applications, CRC Press, Boca Raton, 1993, pp. 276-278) and are preferred base substitutions, even more particularly when combined with 2'-O-methoxyethyl sugar modifications. Representative United States patents that teach the preparation of modified nucleobases include, but are not limited to: U.S. Pat. No. 3,687,808, as well as U.S. Pat. Nos. 4,845,205; 5,130, 302; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,645,985; 5,830,653; 5,763,588; 6,005,096; 5,681,941 and 5,750,692, each of which is herein incorporated by reference.

Another modification of antisense oligonucleotides chemically linking to the oligonucleotide one or more moieties or conjugates which enhance the activity, cellular distribution or cellular uptake of the oligonucleotide. The compounds of the invention can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugates groups include cholesterols, lipids, cation lipids, phospholipids, cationic phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve oligomer uptake, enhance oligomer resistance to degradation, and/or strengthen sequence-specific hybridization with RNA. Groups that enhance the pharmacokinetic properties, in the context of this invention, include groups that improve oligomer uptake, distribution, metabolism or excretion. Conjugate moieties include but are not limited to lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al., Ann. N.Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-oxycholesterol moiety. Oligonucleotides of the invention may also be conjugated to active drug substances, for example, aspirin, warfarin, phenylbutazone, ibuprofen, suprofen, fenbufen, ketoprofen, (S)-(+)-pranoprofen, carprofen, dansylsarcosine, 2,3,5-triiodobenzoic acid, flufenamic acid, folinic acid, a benzothiadiazide, chlorothiazide, a diazepine, indomethicin, a barbiturate, a cephalosporin, a sulfa drug, an antidiabetic, an antibacterial or an antibiotic. Oligonucleotide-drug conjugates and their preparation are described in U.S. patent application Ser. No. 09/334,130 (filed Jun. 15, 1999) and U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4 876,335; 4,904,582; 4,958,013; 5,082,830; 5,112,963; 5,214, 136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

It is not necessary for all positions in a given compound to be uniformly modified, and in fact more than one of the aforementioned modifications may be incorporated in a single compound or even at a single nucleoside within an oligonucleotide. The present invention also includes antisense compounds which are chimeric compounds. "Chimeric" antisense compounds or "chimeras," in the context of this invention, are antisense compounds, particularly oligonucleotides, which contain two or more chemically distinct regions, each made up of at least one monomer unit, i.e., a nucleotide in the case of an oligonucleotide compound. These oligonucleotides typically contain at least one region wherein the oligonucleotide is modified so as to confer upon the oligonucleotide increased resistance to nuclease degradation, increased cellular uptake, and/or increased binding affinity for the target nucleic acid. An additional region of the oligonucleotide may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of oligonucleotide inhibition of gene expression. Consequently, comparable results can often be obtained with shorter oligonucleotides when chimeric oligonucleotides are used, compared to phosphorothioate deoxyoligonucleotides hybridizing to the same target region. Chimeric antisense compounds of the invention may be formed as composite structures of two or more oligonucleotides, modified oligonucleotides, oligonucleosides and/or oligonucleotide mimetics as described above. Preferred chimeric antisense oligonucleotides incorporate at least one 2' modified sugar (preferably 2'-O—$(C_2)_2$—O—$CH_3$) at the 3' terminal to confer nuclease resistance and a region with at least 4 contiguous 2'-H sugars to confer RNase H activity. Such compounds have also been referred to in the art as hybrids or gapmers. Preferred gapmers have a region of 2' modified sugars (preferably 2'-O—$(CH_2)_2$—O—$CH_3$) at the 3'-terminal and at the 5' terminal separated by at least one region having at least 4 contiguous 2'-H sugars and preferably incorporate phosphorothioate backbone linkages. Representative United States patents that teach the preparation of such hybrid structures include, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference in its entirety.

The antisense compounds used in accordance with this invention may be conveniently and routinely made through the well-known technique of solid phase synthesis. Equipment for such synthesis is sold by several vendors including, for example, Applied Biosystems (Foster City, Calif.). Any other means for such synthesis known in the art may additionally or alternatively be employed. It is well known to use similar techniques to prepare oligonucleotides such as the phosphorothioates and alkylated derivatives. The compounds of the invention may also be admixed, encapsulated, conjugated or otherwise associated with other molecules, molecule structures or mixtures of compounds, as for example, liposomes, receptor targeted molecules, oral, rectal, topical or other formulations, for assisting in uptake, distribution and/or absorption. Representative United States patents that teach the preparation of such uptake, distribution and/or absorption assisting formulations include, but are not limited to, U.S. Pat. Nos. 5,108,921; 5,354,844; 5,416,016; 5,459,127; 5,521, 291; 5,543,158; 5,547,932; 5,583,020; 5,591,721; 4,426,330; 4,534,899; 5,013,556; 5,108,921; 5,213,804; 5,227,170; 5,264,221; 5,356,633; 5,395,619; 5,416,016; 5,417,978; 5,462,854; 5,469,854; 5,512,295; 5,527,528; 5,534,259; 5,543,152; 5,556,948; 5,580,575; and 5,595,756, each of which is herein incorporated by reference.

Other examples of sense or antisense oligonucleotides include those oligonucleotides which are covalently linked to organic moieties, such as those described in WO 90/10048, and other moieties that increases affinity of the oligonucleotide for a target nucleic acid sequence, such as poly-(L-lysine). Further still, intercalating agents, such as ellipticine, and alkylating agents or metal complexes may be attached to sense or antisense oligonucleotides to modify binding specificities of the antisense or sense oligonucleotide for the target nucleotide sequence.

Antisense or sense oligonucleotides may be introduced into a cell containing the target nucleic acid sequence by any gene transfer method, including, for example, $Ca_4P$-mediated DNA transfection, electroporation, or by using gene transfer vectors such as Epstein-Barr virus. In a preferred procedure, an antisense or sense oligonucleotide is inserted into a suitable retroviral vector. A cell containing the target nucleic acid sequence is contacted with the recombinant retroviral vector, either in vivo or ex vivo. Suitable retroviral vectors include, but are not limited to, those derived from the murine retrovirus M-MuLV, N2 (a retrovirus derived from M-MuLV), or the double copy vectors designated DCT5A, DCT5B and DCT5C (see WO 90/13641).

Sense or antisense oligonucleotides also may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell.

Alternatively, a sense or an antisense oligonucleotide may be introduced into a cell containing the target nucleic acid sequence by formation of an oligonucleotide-lipid complex, as described in WO 90/10448. The sense or antisense oligonucleotide-lipid complex is preferably dissociated within the cell by an endogenous lipase.

Antisense or sense RNA or DNA molecules are generally at least about 5 nucleotides in length, alternatively at least about 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleotides in length, wherein in this context the term "about" means the referenced nucleotide sequence length plus or minus 10% of that referenced length.

The probes may also be employed in PCR techniques to generate a pool of sequences for identification of closely related TAT coding sequences.

Nucleotide sequences encoding a TAT can also be used to construct hybridization probes for mapping the gene which encodes that TAT and for the genetic analysis of individuals with genetic disorders. The nucleotide sequences provided herein may be mapped to a chromosome and specific regions of a chromosome using known techniques, such as in situ hybridization, linkage analysis against known chromosomal markers, and hybridization screening with libraries.

When the coding sequences for TAT encode a protein which binds to another protein (example, where the TAT is a receptor), the TAT can be used in assays to identify the other proteins or molecules involved in the binding interaction. By such methods, inhibitors of the receptor/ligand binding interaction can be identified. Proteins involved in such binding interactions can also be used to screen for peptide or small molecule inhibitors or agonists of the binding interaction. Also, the receptor TAT can be used to isolate correlative ligand(s). Screening assays can be designed to find lead compounds that mimic the biological activity of a native TAT or a receptor for TAT. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

Nucleic acids which encode TAT or its modified forms can also be used to generate either transgenic animals or "knock out" animals which, in turn, are useful in the development and screening of therapeutically useful reagents. A transgenic animal (e.g., a mouse or rat) is an animal having cells that contain a transgene, which transgene was introduced into the animal or an ancestor of the animal at a prenatal, e.g., an embryonic stage. A transgene is a DNA which is integrated into the genome of a cell from which a transgenic animal develops. In one embodiment, cDNA encoding TAT can be used to clone genomic DNA encoding TAT in accordance with established techniques and the genomic sequences used to generate transgenic animals that contain cells which express DNA encoding TAT. Methods for generating transgenic animals, particularly animals such as mice or rats, have become conventional in the art and are described, for example, in U.S. Pat. Nos. 4,736,866 and 4,870,009. Typically, particular cells would be targeted for TAT transgene incorporation with tissue-specific enhancers. Transgenic animals that include a copy of a transgene encoding TAT introduced into the germ line of the animal at an embryonic stage can be used to examine the effect of increased expression of DNA encoding TAT. Such animals can be used as tester animals for reagents thought to confer protection from, for example, pathological conditions associated with its overexpression. In accordance with this facet of the invention, an animal is treated with the reagent and a reduced incidence of the pathological condition, compared to untreated animals bearing the transgene, would indicate a potential therapeutic intervention for the pathological condition.

Alternatively, non-human homologues of TAT can be used to construct a TAT "knock out" animal which has a defective or altered gene encoding TAT as a result of homologous recombination between the endogenous gene encoding TAT and altered genomic DNA encoding TAT introduced into an embryonic stem cell of the animal. For example, cDNA encoding TAT can be used to clone genomic DNA encoding TAT in accordance with established techniques. A portion of the genomic DNA encoding TAT can be deleted or replaced with another gene, such as a gene encoding a selectable marker which can be used to monitor integration. Typically, several kilobases of unaltered flanking DNA (both at the 5' and 3' ends) are included in the vector [see e.g., Thomas and Capecchi, *Cell*, 51:503 (1987) for a description of homologous recombination vectors]. The vector is introduced into an embryonic stem cell line (e.g., by electroporation) and cells in which the introduced DNA has homologously recombined with the endogenous DNA are selected [see e.g., Li et al., *Cell* 69:915 (1992)]. The selected cells are then injected into a blastocyst of an animal (e.g., a mouse or rat) to form aggregation chimeras (see e.g., Bradley, in *Teratocarcinomas and Embryonic Stem Cells: A Practical Approach*, E. J. Robertson, ed. (IRL, Oxford, 1987), pp. 113-152]. A chimeric embryo can then be implanted into a suitable pseudopregnant female foster animal and the embryo brought to term to create a "knock out" animal. Progeny harboring the homologously recombined DNA in their germ cells can be identified by standard techniques and used to breed animals in which all cells of the animal contain the homologously recombined DNA. Knockout animals can be characterized for instance, for their ability to defend against certain pathological conditions and for their development of pathological conditions due to absence of the TAT polypeptide.

Nucleic acid encoding the TAT polypeptides may also be used in gene therapy. In gene therapy applications, genes are introduced into cells in order to achieve in vivo synthesis of a therapeutically effective genetic product, for example for replacement of a defective gene. "Gene therapy" includes both conventional gene therapy where a lasting effect is achieved by a single treatment, and the administration of gene therapeutic agents, which involves the one time or repeated administration of a therapeutically effective DNA or mRNA. Antisense RNAs and DNAs can be used as therapeutic agents for blocking the expression of certain genes in vivo. It has already been shown that short antisense oligonucleotides can be imported into cells where they act as inhibitors, despite their low intracellular concentrations caused by their restricted uptake by the cell membrane. (Zamecnik et al., *Proc. Natl. Acad. Sci. USA* 83:4143-4146 [1986]). The oligonucleotides can be modified to enhance their uptake, e.g. by substituting their negatively charged phosphodiester groups by uncharged groups.

There are a variety of techniques available for introducing nucleic acids into viable cells. The techniques vary depending upon whether the nucleic acid is transferred into cultured cells in vitro, or in vivo in the cells of the intended host.

Techniques suitable for the transfer of nucleic acid into mammalian cells in vitro include the use of liposomes, electroporation, microinjection, cell fusion, DEAE-dextran, the calcium phosphate precipitation method, etc. The currently preferred in vivo gene transfer techniques include transfection with viral (typically retroviral) vectors and viral coat protein-liposome mediated transfection (Dzau et al., *Trends in Biotechnology* 11, 205-210 [1993]). In some situations it is desirable to provide the nucleic acid source with an agent that targets the target cells, such as an antibody specific for a cell surface membrane protein or the target cell, a ligand for a receptor on the target cell, etc. Where liposomes are employed, proteins which bind to a cell surface membrane protein associated with endocytosis may be used for targeting and/or to facilitate uptake, e.g. capsid proteins or fragments thereof tropic for a particular cell type, antibodies for proteins which undergo internalization in cycling, proteins that target intracellular localization and enhance intracellular half-life. The technique of receptor-mediated endocytosis is described, for example, by Wu et al., *J. Biol. Chem.* 262, 4429-4432 (1987); and Wagner et al., *Proc. Natl. Acad. Sci. USA* 87, 3410-3414 (1990). For review of gene marking and gene therapy protocols see Anderson et al., *Science* 256, 808-813 (1992).

The nucleic acid molecules encoding the TAT polypeptides or fragments thereof described herein are useful for chromosome identification. In this regard, there exists an ongoing need to identify new chromosome markers, since relatively few chromosome marking reagents, based upon actual sequence data are presently available. Each TAT nucleic acid molecule of the present invention can be used as a chromosome marker.

The TAT polypeptides and nucleic acid molecules of the present invention may also be used diagnostically for tissue typing, wherein the TAT polypeptides of the present invention may be differentially expressed in one tissue as compared to another, preferably in a diseased tissue as compared to a normal tissue of the same tissue type. TAT nucleic acid molecules will find use for generating probes for PCR, Northern analysis, Southern analysis and Western analysis.

This invention encompasses methods of screening compounds to identify those that mimic the TAT polypeptide (agonists) or prevent the effect of the TAT polypeptide (antagonists). Screening assays for antagonist drug candidates are designed to identify compounds that bind or complex with the TAT polypeptides encoded by the genes identified herein, or otherwise interfere with the interaction of the encoded polypeptides with other cellular proteins, including e.g., inhibiting the expression of TAT polypeptide from cells. Such screening assays will include assays amenable to high-throughput screening of chemical libraries, making them particularly suitable for identifying small molecule drug candidates.

The assays can be performed in a variety of formats, including protein-protein binding assays, biochemical screening assays, immunoassays, and cell-based assays, which are well characterized in the art.

All assays for antagonists are common in that they call for contacting the drug candidate with a TAT polypeptide encoded by a nucleic acid identified herein under conditions and for a time sufficient to allow these two components to interact.

In binding assays, the interaction is binding and the complex formed can be isolated or detected in the reaction mixture. In a particular embodiment, the TAT polypeptide encoded by the gene identified herein or the drug candidate is immobilized on a solid phase, e.g., on a microtiter plate, by covalent or non-covalent attachments. Non-covalent attachment generally is accomplished by coating the solid surface with a solution of the TAT polypeptide and drying. Alternatively, an immobilized antibody, e.g., a monoclonal antibody, specific for the TAT polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labeled antibody specifically binding the immobilized complex.

If the candidate compound interacts with but does not bind to a particular TAT polypeptide encoded by a gene identified herein, its interaction with that polypeptide can be assayed by methods well known for detecting protein-protein interactions. Such assays include traditional approaches, such as, e.g., cross-linking, co-immunoprecipitation, and co-purification through gradients or chromatographic columns. In addition, protein-protein interactions can be monitored by using a yeast-based genetic system described by Fields and co-workers (Fields and Song, *Nature (London)*, 340:245-246 (1989); Chien et al., *Proc. Natl. Acad. Sci. USA*, 88:9578-9582 (1991)) as disclosed by Chevray and Nathans, *Proc. Natl. Acad. Sci. USA*, 89: 5789-5793 (1991). Many transcriptional activators, such as yeast GAL4, consist of two physically discrete modular domains, one acting as the DNA-binding domain, the other one functioning as the transcription-activation domain. The yeast expression system described in the foregoing publications (generally referred to as the "two-hybrid system") takes advantage of this property, and employs two hybrid proteins, one in which the target protein is fused to the DNA-binding domain of GAL4, and another, in which candidate activating proteins are fused to the activation domain. The expression of a GAL1-lacZ reporter gene under control of a GAL4-activated promoter depends on reconstitution of GAL4 activity via protein-protein interaction. Colonies containing interacting polypeptides are detected with a chromogenic substrate for β-galactosidase. A complete kit (MATCHMAKER™) for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

Compounds that interfere with the interaction of a gene encoding a TAT polypeptide identified herein and other intra- or extracellular components can be tested as follows: usually a reaction mixture is prepared containing the product of the gene and the intra- or extracellular component under conditions and for a time allowing for the interaction and binding of the two products. To test the ability of a candidate compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described hereinabove. The formation of a complex in the control reaction(s) but not in the reaction mixture containing the test compound indicates that the test compound interferes with the interaction of the test compound and its reaction partner.

To assay for antagonists, the TAT polypeptide may be added to a cell along with the compound to be screened for a particular activity and the ability of the compound to inhibit the activity of interest in the presence of the TAT polypeptide indicates that the compound is an antagonist to the TAT polypeptide. Alternatively, antagonists may be detected by combining the TAT polypeptide and a potential antagonist with membrane-bound TAT polypeptide receptors or recombinant receptors under appropriate conditions for a competitive inhibition assay. The TAT polypeptide can be labeled, such as by radioactivity, such that the number of TAT polypeptide molecules bound to the receptor can be used to determine the effectiveness of the potential antagonist. The gene encoding the receptor can be identified by numerous methods known to those of skill in the art, for example, ligand panning and FACS sorting. Coligan et al., *Current Protocols in Immun.*, 1(2): Chapter 5 (1991). Preferably, expression cloning is employed wherein polyadenylated RNA is prepared from a cell responsive to the TAT polypeptide and a cDNA library created from this RNA is divided into pools and used to transfect COS cells or other cells that are not responsive to the TAT polypeptide. Transfected cells that are grown on glass slides are exposed to labeled TAT polypeptide. The TAT polypeptide can be labeled by a variety of means including iodination or inclusion of a recognition site for a site-specific protein kinase. Following fixation and incubation, the slides are subjected to autoradiographic analysis. Positive pools are identified and sub-pools are prepared and re-transfected using an interactive sub-pooling and re-screening process, eventually yielding a single clone that encodes the putative receptor.

As an alternative approach for receptor identification, labeled TAT polypeptide can be photoaffinity-linked with cell membrane or extract preparations that express the receptor molecule. Cross-linked material is resolved by PAGE and exposed to X-ray film. The labeled complex containing the receptor can be excised, resolved into peptide fragments, and subjected to protein micro-sequencing. The amino acid sequence obtained from micro-sequencing would be used to design a set of degenerate oligonucleotide probes to screen a cDNA library to identify the gene encoding the putative receptor.

In another assay for antagonists, mammalian cells or a membrane preparation expressing the receptor would be incubated with labeled TAT polypeptide in the presence of the candidate compound. The ability of the compound to enhance or block this interaction could then be measured.

More specific examples of potential antagonists include an oligonucleotide that binds to the fusions of immunoglobulin with TAT polypeptide, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. Alternatively, a potential antagonist may be a closely related protein, for example, a mutated form of the TAT polypeptide that recognizes the receptor but imparts no effect, thereby competitively inhibiting the action of the TAT polypeptide.

Another potential TAT polypeptide antagonist is an antisense RNA or DNA construct prepared using antisense technology, where, e.g., an antisense RNA or DNA molecule acts to block directly the translation of mRNA by hybridizing to targeted mRNA and preventing protein translation. Antisense technology can be used to control gene expression through triple-helix formation or antisense DNA or RNA, both of which methods are based on binding of a polynucleotide to DNA or RNA. For example, the 5' coding portion of the polynucleotide sequence, which encodes the mature TAT polypeptides herein, is used to design an antisense RNA oligonucleotide of from about 10 to 40 base pairs in length. A DNA oligonucleotide is designed to be complementary to a region of the gene involved in transcription (triple helix—see Lee et al., *Nucl. Acids Res.*, 6:3073 (1979); Cooney et al., *Science*, 241: 456 (1988); Dervan et al., Science, 251:1360 (1991)), thereby preventing transcription and the production of the TAT polypeptide. The antisense RNA oligonucleotide hybridizes to the mRNA in vivo and blocks translation of the mRNA molecule into the TAT polypeptide (antisense—Okano, *Neurochem.*, 56:560 (1991); *Oligodeoxynucleotides as Antisense Inhibitors of Gene Expression* (CRC Press: Boca Raton, Fla., 1988). The oligonucleotides described above can also be delivered to cells such that the antisense RNA or DNA may be expressed in vivo to inhibit production of the TAT polypeptide. When antisense DNA is used, oligodeoxyribonucleotides derived from the translation-initiation site, e.g., between about −10 and +10 positions of the target gene nucleotide sequence, are preferred.

Potential antagonists include small molecules that bind to the active site, the receptor binding site, or growth factor or other relevant binding site of the TAT polypeptide, thereby blocking the normal biological activity of the TAT polypeptide. Examples of small molecules include, but are not limited to, small peptides or peptide-like molecules, preferably soluble peptides, and synthetic non-peptidyl organic or inorganic compounds.

Ribozymes are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see, e.g., Rossi, *Current Biology*, 4:469-471 (1994), and PCT publication No. WO 97/33551 (published Sep. 18, 1997).

Nucleic acid molecules in triple-helix formation used to inhibit transcription should be single-stranded and composed of deoxynucleotides. The base composition of these oligonucleotides is designed such that it promotes triple-helix formation via Hoogsteen base-pairing rules, which generally require sizeable stretches of purines or pyrimidines on one strand of a duplex. For further details see, e.g., PCT publication No. WO 97/33551, supra.

These small molecules can be identified by any one or more of the screening assays discussed hereinabove and/or by any other screening techniques well known for those skilled in the art.

Isolated TAT polypeptide-encoding nucleic acid can be used herein for recombinantly producing TAT polypeptide using techniques well known in the art and as described herein. In turn, the produced TAT polypeptides can be employed for generating anti-TAT antibodies using techniques well known in the art and as described herein.

Antibodies specifically binding a TAT polypeptide identified herein, as well as other molecules identified by the screening assays disclosed hereinbefore, can be administered for the treatment of various disorders, including cancer, in the form of pharmaceutical compositions.

If the TAT polypeptide is intracellular and whole antibodies are used as inhibitors, internalizing antibodies are preferred. However, lipofections or liposomes can also be used to deliver the antibody, or an antibody fragment, into cells.

Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., *Proc. Natl. Acad. Sci. USA*, 90: 7889-7893 (1993).

The formulation herein may also contain more than one active compound as necessary for the particular indication being treated, preferably those with complementary activities that do not adversely affect each other. Alternatively, or in addition, the composition may comprise an agent that enhances its function, such as, for example, a cytotoxic agent, cytokine, chemotherapeutic agent, or growth-inhibitory agent. Such molecules are suitably present in combination in amounts that are effective for the purpose intended.

The following examples are offered for illustrative purposes only, and are not intended to limit the scope of the present invention in any way.

All patent and literature references cited in the present specification are hereby incorporated by reference in their entirety.

EXAMPLES

Commercially available reagents referred to in the examples were used according to manufacturer's instructions unless otherwise indicated. The source of those cells identified in the following examples, and throughout the specification, by ATCC accession numbers is the American Type Culture Collection, Manassas, Va.

Examples 1

Tissue Expression Profiling Using GeneExpress®

A proprietary database containing gene expression information (GeneExpress®, Gene Logic Inc., Gaithersburg, Md.) was analyzed in an attempt to identify polypeptides (and their encoding nucleic acids) whose expression is significantly upregulated in a particular tumor tissue(s) of interest as compared to other tumor(s) and/or normal tissues. Specifically, analysis of the GeneExpress® database was conducted using either software available through Gene Logic Inc., Gaithersburg, Md., for use with the GeneExpress® database or with proprietary software written and developed at Genentech, Inc. for use with the GeneExpress® database. The rating of positive hits in the analysis is based upon several criteria including, for example, tissue specificity, tumor specificity and expression level in normal essential and/or normal proliferating tissues. The following is a list of molecules whose tissue expression profile as determined from an analysis of the GeneExpress® database evidences high tissue expression and significant upregulation of expression in a specific tumor or tumors as compared to other tumor(s) and/or normal tissues and optionally relatively low expression in normal essential and/or normal proliferating tissues. As such, the molecules listed below are excellent polypeptide targets for the diagnosis and therapy of cancer in mammals.

| Molecule | upregulation of expression in: | as compared to: |
|---|---|---|
| DNA77507 (TAT161) | breast tumor | normal breast tissue |
| DNA77507 (TAT161) | colon tumor | normal colon tissue |
| DNA77507 (TAT161) | lung tumor | normal lung tissue |
| DNA77507 (TAT161) | kidney tumor | normal kidney tissue |
| DNA77507 (TAT161) | liver tumor | normal liver tissue |
| DNA77507 (TAT161) | ovarian tumor | normal ovarian tissue |
| DNA77507 (TAT161) | pancreatic tumor | normal pancreatic tissue |
| DNA77507 (TAT161) | rectum tumor | normal rectum tissue |
| DNA77507 (TAT161) | skin tumor | normal skin tissue |
| DNA77507 (TAT161) | uterine tumor | normal uterine tissue |
| DNA77507 (TAT161) | brain tumor | normal brain tissue |
| DNA77507 (TAT161) | soft tissue tumor | normal soft tissue |
| DNA77507 (TAT161) | bone tumor | normal bone tissue |
| DNA80894 (TAT101) | breast tumor | normal breast tissue |
| DNA82343 (TAT157) | colon tumor | normal colon tissue |
| DNA82343 (TAT157) | ovarian tumor | normal ovarian tissue |
| DNA82343 (TAT157) | stomach tumor | normal stomach tissue |
| DNA82343 (TAT157) | liver tumor | normal liver tissue |
| DNA82343 (TAT157) | rectum tumor | normal rectum tissue |
| DNA82343 (TAT157) | small intestine tumor | normal small intestine tissue |
| DNA82343 (TAT157) | esophagus tumor | normal esophagus tissue |
| DNA82343 (TAT157) | testis tumor | normal testis tissue |
| DNA82343 (TAT157) | thymus tumor | normal thymus tissue |
| DNA87994 (TAT160) | breast tumor | normal breast tissue |
| DNA87994 (TAT160) | pancreatic tumor | normal pancreatic tissue |
| DNA87994 (TAT160) | rectum tumor | normal rectum tissue |
| DNA87994 (TAT160) | colon tumor | normal colon tissue |
| DNA87994 (TAT160) | esophagus tumor | normal esophagus tissue |
| DNA87994 (TAT160) | ovarian tumor | normal ovarian tissue |
| DNA87994 (TAT160) | lung tumor | normal lung tissue |
| DNA87994 (TAT160) | uterine tumor | normal uterine tissue |
| DNA88131 (TAT158) | bone tumor | normal bone tissue |
| DNA88131 (TAT158) | breast tumor | normal breast tissue |
| DNA88131 (TAT158) | colon tumor | normal colon tissue |
| DNA88131 (TAT158) | uterine tumor | normal uterine tissue |
| DNA88131 (TAT158) | esophagus tumor | normal esophagus tissue |
| DNA88131 (TAT158) | lung tumor | normal lung tissue |
| DNA88131 (TAT158) | ovarian tumor | normal ovarian tissue |
| DNA88131 (TAT158) | pancreatic tumor | normal pancreatic tissue |
| DNA88131 (TAT158) | prostate tumor | normal prostate tissue |
| DNA88131 (TAT158) | skin tumor | normal skin tissue |
| DNA88131 (TAT158) | soft tissue tumor | normal soft tissue |
| DNA88131 (TAT158) | stomach tumor | normal stomach tissue |
| DNA88131 (TAT158) | rectum tumor | normal rectum tissue |
| DNA88131 (TAT158) | neuroendocrine tumor | normal neuroendocrine tissue |
| DNA88131 (TAT158) | brain tumor | normal brain tissue |
| DNA95930 (TAT110) | colon tumor | normal colon tissue |
| DNA95930 (TAT110) | uterine tumor | normal uterine tissue |
| DNA95930 (TAT110) | endometrial tumor | normal endometrial tissue |
| DNA95930 (TAT110) | rectum tumor | normal rectum tissue |
| DNA95930 (TAT110) | ovarian tumor | normal ovarian tissue |
| DNA95930 (TAT110) | breast tumor | normal breast tissue |
| DNA95930 (TAT110) | lung tumor | normal lung tissue |
| DNA95930 (TAT110) | prostate tumor | normal prostate tissue |
| DNA95930-1 (TAT210) | colon tumor | normal colon tissue |
| DNA95930-1 (TAT210) | uterine tumor | normal uterine tissue |
| DNA95930-1 (TAT210) | endometrial tumor | normal endometrial tissue |
| DNA95930-1 (TAT210) | rectum tumor | normal rectum tissue |
| DNA95930-1 (TAT210) | ovarian tumor | normal ovarian tissue |
| DNA95930-1 (TAT210) | breast tumor | normal breast tissue |
| DNA95930-1 (TAT210) | lung tumor | normal lung tissue |
| DNA95930-1 (TAT210) | prostate tumor | normal prostate tissue |
| DNA96917 (TAT159) | pancreatic tumor | normal pancreatic tissue |
| DNA96917 (TAT159) | lung tumor | normal lung tissue |
| DNA96917 (TAT159) | liver tumor | normal liver tissue |

-continued

| Molecule | upregulation of expression in: | as compared to: |
|---|---|---|
| DNA96930 (TAT112) | breast tumor | normal breast tissue |
| DNA96930 (TAT112) | colon tumor | normal colon tissue |
| DNA96930 (TAT112) | rectum tumor | normal rectum tissue |
| DNA96930 (TAT112) | uterine tumor | normal uterine tissue |
| DNA96930 (TAT112) | lung tumor | normal lung tissue |
| DNA96930 (TAT112) | ovarian tumor | normal ovarian tissue |
| DNA96930 (TAT112) | pancreatic tumor | normal pancreatic tissue |
| DNA96930 (TAT112) | stomach tumor | normal stomach tissue |
| DNA96936 (TAT147) | breast tumor | normal breast tissue |
| DNA96936 (TAT147) | colon tumor | normal colon tissue |
| DNA96936 (TAT147) | testis tumor | normal testis tissue |
| DNA96936 (TAT147) | ovarian tumor | normal ovarian tissue |
| DNA98565 (TAT145) | brain tumor | normal brain tissue |
| DNA98565 (TAT145) | glioma | normal glial tissue |
| DNA246435 (TAT152) | brain tumor | normal brain tissue |
| DNA246435 (TAT152) | glioma | normal glial tissue |
| DNA98591 (TAT162) | colon tumor | normal colon tissue |
| DNA98591 (TAT162) | rectum tumor | normal rectum tissue |
| DNA98591 (TAT162) | ovarian tumor | normal ovarian tissue |
| DNA98591 (TAT162) | pancreatic tumor | normal pancreatic tissue |
| DNA98591 (TAT162) | stomach tumor | normal stomach tissue |
| DNA108809 (TAT114) | colon tumor | normal colon tissue |
| DNA108809 (TAT114) | kidney tumor | normal kidney tissue |
| DNA119488 (TAT119) | colon tumor | normal colon tissue |
| DNA119488 (TAT119) | lung tumor | normal lung tissue |
| DNA119488 (TAT119) | rectum tumor | normal rectum tissue |
| DNA143493 (TAT103) | breast tumor | normal breast tissue |
| DNA167234 (TAT130) | prostate tumor | normal prostate tissue |
| DNA235621 (TAT166) | prostate tumor | normal prostate tissue |
| DNA235621 (TAT166) | liver tumor | normal liver tissue |
| DNA176766 (TAT132) | kidney tumor | normal kidney tissue |
| DNA176766 (TAT132) | ovarian tumor | normal ovarian tissue |
| DNA176766 (TAT132) | uterine tumor | normal uterine tissue |
| DNA236463 (TAT150) | kidney tumor | normal kidney tissue |
| DNA236463 (TAT150) | ovarian tumor | normal ovarian tissue |
| DNA236463 (TAT150) | uterine tumor | normal uterine tissue |
| DNA181162 (TAT129) | prostate tumor | normal prostate tissue |
| DNA188221 (TAT111) | colon tumor | normal colon tissue |
| DNA188221 (TAT111) | endometrial tumor | normal endometrial tissue |
| DNA188221 (TAT111) | stomach tumor | normal stomach tissue |
| DNA233876 (TAT146) | colon tumor | normal colon tissue |
| DNA233876 (TAT146) | endometrial tumor | normal endometrial tissue |
| DNA233876 (TAT146) | stomach tumor | normal stomach tissue |
| DNA193891 (TAT148) | colon tumor | normal colon tissue |
| DNA248170 (TAT187) | colon tumor | normal colon tissue |
| DNA248170 (TAT187) | breast tumor | normal breast tissue |
| DNA194628 (TAT118) | kidney tumor | normal kidney tissue |
| DNA246415 (TAT167) | kidney tumor | normal kidney tissue |
| DNA215609 (TAT113) | colon tumor | normal colon tissue |
| DNA215609 (TAT113) | rectum tumor | normal rectum tissue |
| DNA220432 (TAT128) | prostate tumor | normal prostate tissue |
| DNA226094 (TAT164) | breast tumor | normal breast tissue |
| DNA226094 (TAT164) | brain tumor | normal brain tissue |
| DNA226094 (TAT164) | lung tumor | normal lung tissue |
| DNA226094 (TAT164) | skin tumor | normal skin tissue |
| DNA226165 (TAT122) | breast tumor | normal breast tissue |
| DNA226165 (TAT122) | endometrial tumor | normal endometrial tissue |
| DNA226165 (TAT122) | kidney tumor | normal kidney tissue |
| DNA226165 (TAT122) | lung tumor | normal lung tissue |
| DNA226165 (TAT122) | ovarian tumor | normal ovarian tissue |
| DNA226165 (TAT122) | colon tumor | normal colon tissue |
| DNA226165 (TAT122) | rectum tumor | normal rectum tissue |
| DNA226165 (TAT122) | skin tumor | normal skin tissue |
| DNA226165 (TAT122) | soft tissue tumor | normal soft tissue tissue |
| DNA226165 (TAT122) | bladder tumor | normal bladder tissue |
| DNA226237 (TAT117) | kidney tumor | normal kidney tissue |
| DNA246450 (TAT168) | kidney tumor | normal kidney tissue |
| DNA226456 (TAT144) | breast tumor | normal breast tissue |
| DNA226456 (TAT144) | colon tumor | normal colon tissue |
| DNA226456 (TAT144) | rectum tumor | normal rectum tissue |
| DNA226456 (TAT144) | endometrial tumor | normal endometrial tissue |
| DNA226456 (TAT144) | kidney tumor | normal kidney tissue |
| DNA226456 (TAT144) | lung tumor | normal lung tissue |
| DNA226456 (TAT144) | ovarian tumor | normal ovarian tissue |
| DNA226456 (TAT144) | skin tumor | normal skin tissue |
| DNA237637 (TAT188) | breast tumor | normal breast tissue |
| DNA237637 (TAT188) | colon tumor | normal colon tissue |
| DNA237637 (TAT188) | rectum tumor | normal rectum tissue |
| DNA237637 (TAT188) | endometrial tumor | normal endometrial tissue |
| DNA237637 (TAT188) | kidney tumor | normal kidney tissue |
| DNA237637 (TAT188) | lung tumor | normal lung tissue |
| DNA237637 (TAT188) | ovarian tumor | normal ovarian tissue |
| DNA237637 (TAT188) | skin tumor | normal skin tissue |
| DNA237637 (TAT188) | liver tumor | normal liver tissue |
| DNA237637 (TAT188) | lung tumor | normal lung tissue |
| DNA226539 (TAT126) | breast tumor | normal breast tissue |
| DNA226539 (TAT126) | colon tumor | normal colon tissue |
| DNA226539 (TAT126) | rectum tumor | normal rectum tissue |
| DNA226539 (TAT126) | endometrial tumor | normal endometrial tissue |
| DNA226539 (TAT126) | lung tumor | normal lung tissue |
| DNA226539 (TAT126) | ovarian tumor | normal ovarian tissue |
| DNA226539 (TAT126) | pancreatic tumor | normal pancreatic tissue |
| DNA236511 (TAT151) | breast tumor | normal breast tissue |
| DNA236511 (TAT151) | colon tumor | normal colon tissue |
| DNA236511 (TAT151) | rectum tumor | normal rectum tissue |
| DNA236511 (TAT151) | endometrial tumor | normal endometrial tissue |
| DNA236511 (TAT151) | lung tumor | normal lung tissue |
| DNA236511 (TAT151) | ovarian tumor | normal ovarian tissue |
| DNA236511 (TAT151) | pancreatic tumor | normal pancreatic tissue |
| DNA226771 (TAT115) | breast tumor | normal breast tissue |
| DNA226771 (TAT115) | colon tumor | normal colon tissue |
| DNA227087 (TAT163) | breast tumor | normal breast tissue |
| DNA227087 (TAT163) | colon tumor | normal colon tissue |
| DNA227087 (TAT163) | rectum tumor | normal rectum tissue |
| DNA227087 (TAT163) | lung tumor | normal lung tissue |
| DNA227087 (TAT163) | ovarian tumor | normal ovarian tissue |
| DNA227087 (TAT163) | prostate tumor | normal prostate tissue |
| DNA227087 (TAT163) | endocrine tumor | normal endocrine tissue |
| DNA227087 (TAT163) | kidney tumor | normal kidney tissue |
| DNA227087 (TAT163) | liver tumor | normal liver tissue |
| DNA227087 (TAT163) | nervous system tumor | normal nervous system tissue |
| DNA227087 (TAT163) | pancreatic tumor | normal pancreatic tissue |
| DNA227087 (TAT163) | uterine tumor | normal uterine tissue |
| DNA227087 (TAT163) | small intestine tumor | normal small intestine tissue |
| DNA227087 (TAT163) | lymphoid tumor | normal lymphoid tissue |
| DNA266307 (TAT227) | breast tumor | normal breast tissue |
| DNA266307 (TAT227) | colon tumor | normal colon tissue |
| DNA266307 (TAT227) | rectum tumor | normal rectum tissue |
| DNA266307 (TAT227) | lung tumor | normal lung tissue |
| DNA266307 (TAT227) | ovarian tumor | normal ovarian tissue |
| DNA266307 (TAT227) | prostate tumor | normal prostate tissue |
| DNA266307 (TAT227) | endocrine tumor | normal endocrine tissue |
| DNA266307 (TAT227) | kidney tumor | normal kidney tissue |
| DNA266307 (TAT227) | liver tumor | normal liver tissue |
| DNA266307 (TAT227) | nervous system tumor | normal nervous system tissue |
| DNA266307 (TAT227) | pancreatic tumor | normal pancreatic tissue |
| DNA266307 (TAT227) | uterine tumor | normal uterine tissue |
| DNA266307 (TAT227) | small intestine tumor | normal small intestine tissue |
| DNA266307 (TAT227) | lymphoid tumor | normal lymphoid tissue |

| Molecule | upregulation of expression in: | as compared to: |
|---|---|---|
| DNA266311 (TAT228) | breast tumor | normal breast tissue |
| DNA266311 (TAT228) | colon tumor | normal colon tissue |
| DNA266311 (TAT228) | rectum tumor | normal rectum tissue |
| DNA266311 (TAT228) | lung tumor | normal lung tissue |
| DNA266311 (TAT228) | ovarian tumor | normal ovarian tissue |
| DNA266311 (TAT228) | prostate tumor | normal prostate tissue |
| DNA266311 (TAT228) | endocrine tumor | normal endocrine tissue |
| DNA266311 (TAT228) | kidney tumor | normal kidney tissue |
| DNA266311 (TAT228) | liver tumor | normal liver tissue |
| DNA266311 (TAT228) | nervous system tumor | normal nervous system tissue |
| DNA266311 (TAT228) | pancreatic tumor | normal pancreatic tissue |
| DNA266311 (TAT228) | uterine tumor | normal uterine tissue |
| DNA266311 (TAT228) | small intestine tumor | normal small intestine tissue |
| DNA266311 (TAT228) | lymphoid tumor | normal lymphoid tissue |
| DNA266312 (TAT229) | breast tumor | normal breast tissue |
| DNA266312 (TAT229) | colon tumor | normal colon tissue |
| DNA266312 (TAT229) | rectum tumor | normal rectum tissue |
| DNA266312 (TAT229) | lung tumor | normal lung tissue |
| DNA266312 (TAT229) | ovarian tumor | normal ovarian tissue |
| DNA266312 (TAT229) | prostate tumor | normal prostate tissue |
| DNA266312 (TAT229) | endocrine tumor | normal endocrine tissue |
| DNA266312 (TAT229) | kidney tumor | normal kidney tissue |
| DNA266312 (TAT229) | liver tumor | normal liver tissue |
| DNA266312 (TAT229) | nervous system tumor | normal nervous system tissue |
| DNA266312 (TAT229) | pancreatic tumor | normal pancreatic tissue |
| DNA266312 (TAT229) | uterine tumor | normal uterine tissue |
| DNA266312 (TAT229) | small intestine tumor | normal small intestine tissue |
| DNA266312 (TAT229) | lymphoid tumor | normal lymphoid tissue |
| DNA266313 (TAT230) | breast tumor | normal breast tissue |
| DNA266313 (TAT230) | colon tumor | normal colon tissue |
| DNA266313 (TAT230) | rectum tumor | normal rectum tissue |
| DNA266313 (TAT230) | lung tumor | normal lung tissue |
| DNA266313 (TAT230) | ovarian tumor | normal ovarian tissue |
| DNA266313 (TAT230) | prostate tumor | normal prostate tissue |
| DNA266313 (TAT230) | endocrine tumor | normal endocrine tissue |
| DNA266313 (TAT230) | kidney tumor | normal kidney tissue |
| DNA266313 (TAT230) | liver tumor | normal liver tissue |
| DNA266313 (TAT230) | nervous system tumor | normal nervous system tissue |
| DNA266313 (TAT230) | pancreatic tumor | normal pancreatic tissue |
| DNA266313 (TAT230) | uterine tumor | normal uterine tissue |
| DNA266313 (TAT230) | small intestine tumor | normal small intestine tissue |
| DNA266313 (TAT230) | lymphoid tumor | normal lymphoid tissue |
| DNA227224 (TAT121) | breast tumor | normal breast tissue |
| DNA227224 (TAT121) | colon tumor | normal colon tissue |
| DNA227224 (TAT121) | rectum tumor | normal rectum tissue |
| DNA227224 (TAT121) | endometrial tumor | normal endometrial tissue |
| DNA227224 (TAT121) | kidney tumor | normal kidney tissue |
| DNA227224 (TAT121) | lung tumor | normal lung tissue |
| DNA227224 (TAT121) | ovarian tumor | normal ovarian tissue |
| DNA227224 (TAT121) | skin tumor | normal skin tissue |
| DNA227224 (TAT121) | testis tumor | normal testis tissue |
| DNA227224 (TAT121) | bladder tumor | normal bladder tissue |
| DNA247486 (TAT183) | breast tumor | normal breast tissue |
| DNA247486 (TAT183) | colon tumor | normal colon tissue |
| DNA247486 (TAT183) | rectum tumor | normal rectum tissue |
| DNA247486 (TAT183) | endometrial tumor | normal endometrial tissue |
| DNA247486 (TAT183) | kidney tumor | normal kidney tissue |
| DNA247486 (TAT183) | lung tumor | normal lung tissue |
| DNA247486 (TAT183) | ovarian tumor | normal ovarian tissue |
| DNA247486 (TAT183) | skin tumor | normal skin tissue |
| DNA247486 (TAT183) | testis tumor | normal testis tissue |
| DNA247486 (TAT183) | bladder tumor | normal bladder tissue |
| DNA227800 (TAT131) | prostate tumor | normal prostate tissue |
| DNA228199 (TAT127) | breast tumor | normal breast tissue |
| DNA228199 (TAT127) | endometrial tumor | normal endometrial tissue |
| DNA228199 (TAT127) | ovarian tumor | normal ovarian tissue |
| DNA228199 (TAT127) | pancreatic tumor | normal pancreatic tissue |
| DNA228199 (TAT127) | lung tumor | normal lung tissue |
| DNA228201 (TAT116) | colon tumor | normal colon tissue |
| DNA228201 (TAT116) | rectum tumor | normal rectum tissue |
| DNA247488 (TAT189) | colon tumor | normal colon tissue |
| DNA247488 (TAT189) | rectum tumor | normal rectum tissue |
| DNA236538 (TAT190) | colon tumor | normal colon tissue |
| DNA236538 (TAT190) | rectum tumor | normal rectum tissue |
| DNA247489 (TAT191) | colon tumor | normal colon tissue |
| DNA247489 (TAT191) | rectum tumor | normal rectum tissue |
| DNA228211 (TAT133) | uterine tumor | normal uterine tissue |
| DNA233937 (TAT186) | uterine tumor | normal uterine tissue |
| DNA233937 (TAT186) | ovarian tumor | normal ovarian tissue |
| DNA228994 (TAT124) | lung tumor | normal lung tissue |
| DNA228994 (TAT124) | ovarian tumor | normal ovarian tissue |
| DNA228994 (TAT124) | skin tumor | normal skin tissue |
| DNA228994 (TAT124) | breast tumor | normal breast tissue |
| DNA229410 (TAT105) | breast tumor | normal breast tissue |
| DNA229411 (TAT107) | breast tumor | normal breast tissue |
| DNA229413 (TAT108) | breast tumor | normal breast tissue |
| DNA229700 (TAT139) | breast tumor | normal breast tissue |
| DNA231312 (TAT143) | breast tumor | normal breast tissue |
| DNA231312 (TAT143) | colon tumor | normal colon tissue |
| DNA231542 (TAT100) | brain tumor | normal brain tissue |
| DNA231542 (TAT100) | glioma | normal glial tissue |
| DNA231542-1 (TAT284) | brain tumor | normal brain tissue |
| DNA231542-1 (TAT284) | glioma | normal glial tissue |
| DNA231542-2 (TAT285) | brain tumor | normal brain tissue |
| DNA231542-2 (TAT285) | glioma | normal glial tissue |
| DNA297393 (TAT285-1) | brain tumor | normal brain tissue |
| DNA297393 (TAT285-1) | glioma | normal glial tissue |
| DNA234833 (TAT149) | colon tumor | normal colon tissue |
| DNA268022 (TAT231) | colon tumor | normal colon tissue |
| DNA268022 (TAT231) | breast tumor | normal breast tissue |
| DNA268022 (TAT231) | ovarian tumor | normal ovarian tissue |
| DNA236246 (TAT153) | breast tumor | normal breast tissue |
| DNA236343 (TAT104) | breast tumor | normal breast tissue |
| DNA236493 (TAT141) | breast tumor | normal breast tissue |
| DNA236493 (TAT141) | glioblastoma tumor | normal glial tissue |
| DNA236534 (TAT102) | breast tumor | normal breast tissue |
| DNA236534 (TAT102) | colon tumor | normal colon tissue |
| DNA236534 (TAT102) | rectum tumor | normal rectum tissue |
| DNA236534 (TAT102) | cervical tumor | normal cervical tissue |
| DNA236534 (TAT102) | endometrial tumor | normal endometrial tissue |
| DNA236534 (TAT102) | lung tumor | normal lung tissue |
| DNA236534 (TAT102) | ovarian tumor | normal ovarian tissue |
| DNA236534 (TAT102) | pancreatic tumor | normal pancreatic tissue |
| DNA236534 (TAT102) | prostate tumor | normal prostate tissue |
| DNA236534 (TAT102) | stomach tumor | normal stomach tissue |
| DNA236534 (TAT102) | bladder tumor | normal bladder tissue |
| DNA246430 (TAT109) | breast tumor | normal breast tissue |
| DNA246430 (TAT109) | prostate tumor | normal prostate tissue |
| DNA247480 (TAT142) | breast tumor | normal breast tissue |
| DNA247480 (TAT142) | lung tumor | normal lung tissue |
| DNA264454 (TAT106) | breast tumor | normal breast tissue |

Example 2

Microarray Analysis to Detect Upregulation of TAT Polypeptides in Cancerous Tumors Nucleic acid microarrays, often containing thousands of gene sequences, are useful for identifying differentially expressed genes in diseased tissues as compared to their normal counterparts. Using nucleic acid microarrays, test and control mRNA samples from test and control tissue samples are reverse transcribed and labeled to generate cDNA probes. The cDNA probes are then hybridized to an array of nucleic acids immobilized on a solid support. The array is configured such that the sequence and position of each member of the array is known. For example, a selection of genes known to be expressed in certain disease states may be arrayed on a solid support. Hybridization of a labeled probe with a particular array member indicates that the sample from which the probe was derived expresses that gene. If the hybridization signal of a probe from a test (disease tissue) sample is greater than hybridization signal of a probe from a control (normal tissue) sample, the gene or genes overexpressed in the disease tissue are identified. The implication of this result is that an overexpressed protein in a diseased tissue is useful not only as a diagnostic marker for the presence of the disease condition, but also as a therapeutic target for treatment of the disease condition.

The methodology of hybridization of nucleic acids and microarray technology is well known in the art. In one example, the specific preparation of nucleic acids for hybridization and probes, slides, and hybridization conditions are all detailed in PCT Patent Application Ser. No. PCT/US01/10482, filed on Mar. 30, 2001 and which is herein incorporated by reference.

In the present example, cancerous tumors derived from various human tissues were studied for upregulated gene expression relative to cancerous tumors from different tissue types and/or non-cancerous human tissues in an attempt to identify those polypeptides which are overexpressed in a particular cancerous tumor(s). In certain experiments, cancerous human tumor tissue and non-cancerous human tumor tissue of the same tissue type (often from the same patient) were obtained and analyzed for TAT polypeptide expression. Additionally, cancerous human tumor tissue from any of a variety of different human tumors was obtained and compared to a "universal" epithelial control sample which was prepared by pooling non-cancerous human tissues of epithelial origin, including liver, kidney, and lung. mRNA isolated from the pooled tissues represents a mixture of expressed gene products from these different tissues. Microarray hybridization experiments using the pooled control samples generated a linear plot in a 2-color analysis. The slope of the line generated in a 2-color analysis was then used to normalize the ratios of (test:control detection) within each experiment. The normalized ratios from various experiments were then compared and used to identify clustering of gene expression. Thus, the pooled "universal control" sample not only allowed effective relative gene expression determinations in a simple 2-sample comparison, it also allowed multi-sample comparisons across several experiments.

In the present experiments, nucleic acid probes derived from the herein described TAT polypeptide-encoding nucleic acid sequences were used in the creation of the microarray and RNA from various tumor tissues were used for the hybridization thereto. Below is shown the results of these experiments, demonstrating that various TAT polypeptides of the present invention are significantly overexpressed in various human tumor tissues as compared to their normal counterpart tissue(s). Moreover, all of the molecules shown below are significantly overexpressed in their specific tumor tissue(s) as compared to in the "universal" epithelial control. As described above, these data demonstrate that the TAT polypeptides of the present invention are useful not only as diagnostic markers for the presence of one or more cancerous tumors, but also serve as therapeutic targets for the treatment of those tumors.

| Molecule | upregulation of expression in: | as compared to: |
| --- | --- | --- |
| DNA95930 (TAT110) | colon tumor | normal colon tissue |
| DNA95930 (TAT110) | lung tumor | normal lung tissue |
| DNA95930 (TAT110) | prostate tumor | normal prostate tissue |
| DNA95930 (TAT110) | endometrial tumor | normal endometrial tissue |
| DNA95930 (TAT110) | ovarian tumor | normal ovarian tissue |
| DNA95930-1 (TAT210) | colon tumor | normal colon tissue |
| DNA95930-1 (TAT210) | lung tumor | normal lung tissue |
| DNA95930-1 (TAT210) | prostate tumor | normal prostate tissue |
| DNA95930-1 (TAT210) | endometrial tumor | normal endometrial tissue |
| DNA95930-1 (TAT210) | ovarian tumor | normal ovarian tissue |
| DNA96930 (TAT112) | colon tumor | normal colon tissue |
| DNA96930 (TAT112) | breast tumor | normal breast tissue |
| DNA96930 (TAT112) | lung tumor | normal lung tissue |
| DNA96936 (TAT147) | breast tumor | normal breast tissue |
| DNA96936 (TAT147) | colon tumor | normal colon tissue |
| DNA96936 (TAT147) | ovarian tumor | normal ovarian tissue |
| DNA96936 (TAT147) | prostate tumor | normal prostate tissue |
| DNA108809 (TAT114) | colon tumor | normal colon tissue |
| DNA119488 (TAT119) | colon tumor | normal colon tissue |
| DNA119488 (TAT119) | lung tumor | normal lung tissue |
| DNA143493 (TAT103) | breast tumor | normal breast tissue |
| DNA181162 (TAT129) | prostate tumor | normal prostate tissue |
| DNA188221 (TAT111) | colon tumor | normal colon tissue |
| DNA188221 (TAT111) | lung tumor | normal lung tissue |
| DNA188221 (TAT111) | ovarian tumor | normal ovarian tissue |
| DNA233876 (TAT146) | colon tumor | normal colon tissue |
| DNA233876 (TAT146) | lung tumor | normal lung tissue |
| DNA233876 (TAT146) | ovarian tumor | normal ovarian tissue |
| DNA210499 (TAT123) | ovarian tumor | normal ovarian tissue |
| DNA210499 (TAT123) | lung tumor | normal lung tissue |
| DNA219894 (TAT211) | ovarian tumor | normal ovarian tissue |
| DNA219894 (TAT211) | lung tumor | normal lung tissue |
| DNA215609 (TAT113) | colon tumor | normal colon tissue |
| DNA220432 (TAT128) | prostate tumor | normal prostate tissue |
| DNA226165 (TAT122) | breast tumor | normal breast tissue |
| DNA226165 (TAT122) | colon tumor | normal colon tissue |
| DNA226165 (TAT122) | rectum tumor | normal rectum tissue |
| DNA226165 (TAT122) | lung tumor | normal lung tissue |
| DNA226165 (TAT122) | ovarian tumor | normal ovarian tissue |
| DNA226165 (TAT122) | prostate tumor | normal prostate tissue |
| DNA226456 (TAT144) | breast tumor | normal breast tissue |
| DNA226456 (TAT144) | colon tumor | normal colon tissue |
| DNA237637 (TAT188) | breast tumor | normal breast tissue |
| DNA237637 (TAT188) | colon tumor | normal colon tissue |
| DNA226539 (TAT126) | rectum tumor | normal rectum tissue |
| DNA226539 (TAT126) | colon tumor | normal colon tissue |
| DNA226539 (TAT126) | lung tumor | normal lung tissue |
| DNA226539 (TAT126) | ovarian tumor | normal ovarian tissue |
| DNA236511 (TAT151) | rectum tumor | normal rectum tissue |
| DNA236511 (TAT151) | colon tumor | normal colon tissue |
| DNA236511 (TAT151) | lung tumor | normal lung tissue |
| DNA236511 (TAT151) | ovarian tumor | normal ovarian tissue |
| DNA226771 (TAT115) | colon tumor | normal colon tissue |
| DNA227224 (TAT121) | ovarian tumor | normal ovarian tissue |
| DNA227224 (TAT121) | rectum tumor | normal rectum tissue |
| DNA227224 (TAT121) | colon tumor | normal colon tissue |
| DNA227224 (TAT121) | lung tumor | normal lung tissue |
| DNA227224 (TAT121) | breast tumor | normal breast tissue |
| DNA227224 (TAT121) | prostate tumor | normal prostate tissue |
| DNA247486 (TAT183) | ovarian tumor | normal ovarian tissue |
| DNA247486 (TAT183) | rectum tumor | normal rectum tissue |
| DNA247486 (TAT183) | colon tumor | normal colon tissue |
| DNA247486 (TAT183) | lung tumor | normal lung tissue |
| DNA247486 (TAT183) | breast tumor | normal breast tissue |
| DNA247486 (TAT183) | prostate tumor | normal prostate tissue |
| DNA228199 (TAT127) | ovarian tumor | normal ovarian tissue |
| DNA228199 (TAT127) | lung tumor | normal lung tissue |
| DNA228201 (TAT116) | colon tumor | normal colon tissue |
| DNA247488 (TAT189) | colon tumor | normal colon tissue |
| DNA236538 (TAT190) | colon tumor | normal colon tissue |

-continued

| Molecule | upregulation of expression in: | as compared to: |
|---|---|---|
| DNA247489 (TAT191) | colon tumor | normal colon tissue |
| DNA228994 (TAT124) | lung tumor | normal lung tissue |
| DNA228994 (TAT124) | breast tumor | normal breast tissue |
| DNA228994 (TAT124) | ovarian tumor | normal ovarian tissue |
| DNA231312 (TAT143) | colon tumor | normal colon tissue |
| DNA231542 (TAT100) | brain tumor | normal brain tissue |
| DNA231542 (TAT100) | glioma | normal glial tissue |
| DNA231542-1 (TAT284) | brain tumor | normal brain tissue |
| DNA231542-1 (TAT284) | glioma | normal glial tissue |
| DNA231542-2 (TAT285) | brain tumor | normal brain tissue |
| DNA231542-2 (TAT285) | glioma | normal glial tissue |
| DNA297393 (TAT285-1) | brain tumor | normal brain tissue |
| DNA297393 (TAT285-1) | glioma | normal glial tissue |
| DNA236246 (TAT153) | breast tumor | normal breast tissue |
| DNA236343 (TAT104) | breast tumor | normal breast tissue |
| DNA236534 (TAT102) | breast tumor | normal breast tissue |
| DNA236534 (TAT102) | colon tumor | normal colon tissue |
| DNA246430 (TAT109) | prostate tumor | normal prostate tissue |
| DNA264454 (TAT106) | breast tumor | normal breast tissue |
| DNA98565 (TAT145) | glioma | normal brain tissue |
| DNA246435 (TAT152) | glioma | normal brain tissue |
| DNA226094 (TAT164) | glioma | normal brain tissue |

Example 3

Quantitative Analysis of TAT mRNA Expression

In this assay, a 5' nuclease assay (for example, TaqMan®) and real-time quantitative PCR (for example, ABI Prizm 7700 Sequence Detection System® (Perkin Elmer, Applied Biosystems Division, Foster City, Calif.)), were used to find genes that are significantly overexpressed in a cancerous tumor or tumors as compared to other cancerous tumors or normal non-cancerous tissue. The 5' nuclease assay reaction is a fluorescent PCR-based technique which makes use of the 5' exonuclease activity of Taq DNA polymerase enzyme to monitor gene expression in real time. Two oligonucleotide primers (whose sequences are based upon the gene or EST sequence of interest) are used to generate an amplicon typical of a PCR reaction. A third oligonucleotide, or probe, is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the PCR amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

The 5' nuclease procedure is run on a real-time quantitative PCR device such as the ABI Prism 7700™ Sequence Detection. The system consists of a thermocycler, laser, charge-coupled device (CCD) camera and computer. The system amplifies samples in a 96-well format on a thermocycler. During amplification, laser-induced fluorescent signal is collected in real-time through fiber optics cables for all 96 wells, and detected at the CCD. The system includes software for running the instrument and for analyzing the data.

The starting material for the screen was mRNA isolated from a variety of different cancerous tissues. The mRNA is quantitated precisely, e.g., fluorometrically. As a negative control, RNA was isolated from various normal tissues of the same tissue type as the cancerous tissues being tested.

5' nuclease assay data are initially expressed as Ct, or the threshold cycle. This is defined as the cycle at which the reporter signal accumulates above the background level of fluorescence. The ΔCt values are used as quantitative measurement of the relative number of starting copies of a particular target sequence in a nucleic acid sample when comparing cancer mRNA results to normal human mRNA results. As one Ct unit corresponds to 1 PCR cycle or approximately a 2-fold relative increase relative to normal, two units corresponds to a 4-fold relative increase, 3 units corresponds to an 8-fold relative increase and so on, one can quantitatively measure the relative fold increase in mRNA expression between two or more different tissues. Using this technique, the molecules listed below have been identified as being significantly overexpressed in a particular tumor(s) as compared to their normal non-cancerous counterpart tissue(s) (from both the same and different tissue donors) and thus, represent excellent polypeptide targets for the diagnosis and therapy of cancer in mammals.

| Molecule | upregulation of expression in: | as compared to: |
|---|---|---|
| DNA77507 (TAT161) | breast tumor | normal breast tissue |
| DNA82343 (TAT157) | colon tumor | normal colon tissue |
| DNA88131 (TAT158) | breast tumor | normal breast tissue |
| DNA88131 (TAT158) | colon tumor | normal colon tissue |
| DNA95930 (TAT110) | colon tumor | normal colon tissue |
| DNA95930 (TAT110) | lung tumor | normal lung tissue |
| DNA95930 (TAT110) | prostate tumor | normal prostate tissue |
| DNA95930 (TAT110) | endometrial tumor | normal endometrial tissue |
| DNA95930 (TAT110) | ovarian tumor | normal ovarian tissue |
| DNA95930-1 (TAT210) | colon tumor | normal colon tissue |
| DNA95930-1 (TAT210) | lung tumor | normal lung tissue |
| DNA95930-1 (TAT210) | prostate tumor | normal prostate tissue |
| DNA95930-1 (TAT210) | endometrial tumor | normal endometrial tissue |
| DNA95930-1 (TAT210) | ovarian tumor | normal ovarian tissue |
| DNA96930 (TAT112) | colon tumor | normal colon tissue |
| DNA96936 (TAT147) | colon tumor | normal colon tissue |
| DNA98591 (TAT162) | colon tumor | normal colon tissue |
| DNA108809 (TAT114) | kidney tumor | normal kidney tissue |
| DNA119488 (TAT119) | lung tumor | normal lung tissue |
| DNA188221 (TAT111) | colon tumor | normal colon tissue |
| DNA233876 (TAT146) | colon tumor | normal colon tissue |
| DNA193891 (TAT148) | colon tumor | normal colon tissue |
| DNA248170 (TAT187) | colon tumor | normal colon tissue |
| DNA194628 (TAT118) | kidney tumor | normal kidney tissue |
| DNA246415 (TAT167) | kidney tumor | normal kidney tissue |
| DNA210499 (TAT123) | lung tumor | normal lung tissue |
| DNA219894 (TAT211) | lung tumor | normal lung tissue |
| DNA215609 (TAT113) | colon tumor | normal colon tissue |
| DNA220432 (TAT128) | prostate tumor | normal prostate tissue |
| DNA226165 (TAT122) | lung tumor | normal lung tissue |
| DNA226237 (TAT117) | kidney tumor | normal kidney tissue |
| DNA246450 (TAT168) | kidney tumor | normal kidney tissue |
| DNA226456 (TAT144) | breast tumor | normal breast tissue |
| DNA237637 (TAT188) | breast tumor | normal breast tissue |
| DNA226539 (TAT126) | ovarian tumor | normal ovarian tissue |
| DNA236511 (TAT151) | ovarian tumor | normal ovarian tissue |
| DNA227224 (TAT121) | lung tumor | normal lung tissue |
| DNA247486 (TAT183) | lung tumor | normal lung tissue |
| DNA227800 (TAT131) | prostate tumor | normal prostate tissue |
| DNA228199 (TAT127) | ovarian tumor | normal ovarian tissue |
| DNA228199 (TAT127) | lung tumor | normal lung tissue |
| DNA228201 (TAT116) | colon tumor | normal colon tissue |
| DNA247488 (TAT189) | colon tumor | normal colon tissue |
| DNA236538 (TAT190) | colon tumor | normal colon tissue |
| DNA247489 (TAT191) | colon tumor | normal colon tissue |
| DNA228993 (TAT120) | lung tumor | normal lung tissue |

-continued

| Molecule | upregulation of expression in: | as compared to: |
|---|---|---|
| DNA228994 (TAT124) | lung tumor | normal lung tissue |
| DNA236343 (TAT104) | breast tumor | normal breast tissue |
| DNA236534 (TAT102) | ovarian tumor | normal ovarian tissue |
| DNA246430 (TAT109) | breast tumor | normal breast tissue |
| DNA247480 (TAT142) | lung tumor | normal lung tissue |
| DNA98565 (TAT145) | glioma | normal brain tissue |
| DNA246435 (TAT152) | glioma | normal brain tissue |
| DNA226094 (TAT164) | glioma | normal brain tissue |
| DNA227578 (TAT165) | glioma | normal brain tissue |
| DNA231542 (TAT100) | glioma | normal brain tissue |
| DNA231542-1 (TAT284) | glioma | normal brain tissue |
| DNA231542-2 (TAT285) | glioma | normal brain tissue |
| DNA297393 (TAT285-1) | glioma | normal brain tissue |

Example 4

In situ Hybridization

In situ hybridization is a powerful and versatile technique for the detection and localization of nucleic acid sequences within cell or tissue preparations. It may be useful, for example, to identify sites of gene expression, analyze the tissue distribution of transcription, identify and localize viral infection, follow changes in specific mRNA synthesis and aid in chromosome mapping.

In situ hybridization was performed following an optimized version of the protocol by Lu and Gillett, *Cell Vision* 1:169-176 (1994), using PCR-generated 33P-labeled riboprobes. Briefly, formalin-fixed, paraffin-embedded human tissues were sectioned, deparaffinized, deproteinated in proteinase K (20 g/ml) for 15 minutes at 37° C., and further processed for in situ hybridization as described by Lu and Gillett, supra. A [$^{33}$-P] UTP-labeled antisense riboprobe was generated from a PCR product and hybridized at 55° C. overnight. The slides were dipped in Kodak NTB2 nuclear track emulsion and exposed for 4 weeks.

$^{33}$P-Riboprobe synthesis 6.0 µl (125 mCi) of $^{33}$P-UTP (Amersham BF 1002, SA<2000 Ci/mmol) were speed vac dried. To each tube containing dried $^{33}$P-UTP, the following ingredients were added:

2.0 µl 5× transcription buffer
1.0 µl DTT (100 mM)
2.0 µl NTP mix (2.5 mM: 10 µL; each of 10 mM GTP, CTP & ATP+10 µl H$_2$O)
1.0 µl UTP (50 µM)
1.0 µl Rnasin
1.0 µl DNA template (1 µg)
1.0 µl H$_2$O
1.0 µl RNA polymerase (for PCR products T3=AS, T7=S, usually)

The tubes were incubated at 37° C. for one hour. 1.0 µl RQI DNase were added, followed by incubation at 37° C. for 15 minutes. 90 µl TE (10 mM Tris pH 7.6/1 mM EDTA pH 8.0) were added, and the mixture was pipetted onto DE81 paper. The remaining solution was loaded in a Microcon-50 ultrafiltration unit, and spun using program 10 (6 minutes). The filtration unit was inverted over a second tube and spun using program 2 (3 minutes). After the final recovery spin, 100 µl TE were added. 1 µl of the final product was pipetted on DE81 paper and counted in 6 ml of Biofluor II.

The probe was run on a TBE/urea gel. 1-3 µl of the probe or 5 µl of RNA Mrk III were added to 3 µl of loading buffer. After heating on a 95° C. heat block for three minutes, the probe was immediately placed on ice. The wells of gel were flushed, the sample loaded, and run at 180-250 volts for 45 minutes. The gel was wrapped in saran wrap and exposed to XAR film with an intensifying screen in −70° C. freezer one hour to overnight.

$^{33}$P-Hybridization

A. Pretreatment of frozen sections

The slides were removed from the freezer, placed on aluminium trays and thawed at room temperature for 5 minutes. The trays were placed in 55° C. incubator for five minutes to reduce condensation. The slides were fixed for 10 minutes in 4% paraformaldehyde on ice in the fume hood, and washed in 0.5×SSC for 5 minutes, at room temperature (25 ml 20×SSC+975 ml SQ H$_2$O). After deproteination in 0.5 µg/ml proteinase K for 10 minutes at 37° C. (12.5 µl of 10 mg/ml stock in 250 ml prewarmed RNase-free RNAse buffer), the sections were washed in 0.5×SSC for 10 minutes at room temperature. The sections were dehydrated in 70%, 95%, 100% ethanol, 2 minutes each.

B. Pretreatment of Paraffin-Embedded Sections

The slides were deparaffinized, placed in SQ H$_2$O, and rinsed twice in 2×SSC at room temperature, for 5 minutes each time. The sections were deproteinated in 20 µg/ml proteinase K (500 µl of 10 mg/ml in 250 ml RNase-free RNase buffer; 37° C., 15 minutes)—human embryo, or 8× proteinase K (100 µl in 250 ml Rnase buffer, 37° C., 30 minutes)—formalin tissues. Subsequent rinsing in 0.5×SSC and dehydration were performed as described above.

C. Prehybridization

The slides were laid out in a plastic box lined with Box buffer (4×SSC, 50% formamide)—saturated filter paper.

D. Hybridization 1.0×10$^6$ cpm probe and 1.0 µl tRNA (50 mg/ml stock) per slide were heated at 95° C. for 3 minutes slides were cooled on ice, and 48 µl hybridization buffer were added per slide. After vortexing, 5 µl $^{33}$P mix were added to 50 µl prehybridization on slide. The slides were incubated overnight at 55° C.

E. Washes

Washing was done 2×10 minutes with 2×SSC, EDTA at room temperature (400 ml 20×SSC+16 ml 0.25M EDTA, $V_f$=4L), followed by RNaseA treatment at 37° C. for 30 minutes (500 µl of 10 mg/ml in 250 ml Rnase buffer=20 µg/ml), The slides were washed 2×10 minutes with 2×SSC, EDTA at room temperature. The stringency wash conditions were as follows: 2 hours at 55° C., 0.1×SSC, EDTA (20 ml 20×SSC+16 $V_f$=4L).

F. Oligonucleotides

In situ analysis was performed on a variety of DNA sequences disclosed herein. The oligonucleotides employed for these analyses were obtained so as to be complementary to the nucleic acids (or the complements thereof) as shown in the accompanying figures.

G. Results

In situ analysis was performed on a variety of DNA sequences disclosed herein. The results from these analyses are as follows.

(1) DNA95930 (TAT110)

In one analysis, significant expression is observed in 3/3 lung tumors, 3/3 colorectal adenocarcinomas, 1/1 prostate cancers, 3/3 transitional cell carcinomas and 3/3 endometrial adenocarcinomas, wherein the level of expression in the counterpart normal tissues is significantly less.

In a second independent analysis, significant expression is observed in 7/7 endometrial and 12/15 ovarian adenocarcinomas, wherein the level of expression in the counterpart normal tissues is significantly less.

In a third independent analysis, significant expression is observed in 24/26 colorectal tumor samples, wherein the level of expression in the counterpart normal tissue is significantly less.

Finally, in a fourth independent analysis, expression is observed in 8/26 samples of non-malignant prostate tissue, 55/82 samples of primary prostate cancer and in 5/23 samples of metastatic prostate cancer.

(2) DNA95930-1 (TAT210)

In one analysis, significant expression is observed in 3/3 lung tumors, 3/3 colorectal adenocarcinomas, 1/1 prostate cancers, 3/3 transitional cell carcinomas and 3/3 endometrial adenocarcinomas, wherein the level of expression in the counterpart normal tissues is significantly less.

In a second independent analysis, significant expression is observed in 7/7 endometrial and 12/15 ovarian adenocarcinomas, wherein the level of expression in the counterpart normal tissues is significantly less.

In a third independent analysis, significant expression is observed in 24/26 colorectal tumor samples, wherein the level of expression in the counterpart normal tissue is significantly less.

Finally, in a fourth independent analysis, expression is observed in 8/26 samples of non-malignant prostate tissue, 55/82 samples of primary prostate cancer and in 5/23 samples of metastatic prostate cancer.

(3) DNA96930 (TAT112)

Strong expression in colorectal cancers. Expression in the malignant epithelium appears significantly stronger than in adjacent benign epithelium. Additionally, strong expression is observed in all 23 of 23 samples of pancreatic adenocarcinoma tested, wherein expression in normal pancreatic tissue is not detectable.

(4) DNA96936 (TAT147)

In one analysis, a strongly positive signal was observed in 6/6 breast tumors. In another independent analysis, a positive signal was observed in 4/4 non small cell lung carcinomas, wherein the tumors appear to have stronger expression compared with normal lung. 1/1 endometrial adenocarcinomas shows strong expression and 3/3 colorectal adenocarcinomas show variable expression.

(5) DNA108809 (TAT114)

Positive signal in all renal cell carcinomas tested (n=3) while no expression observed in normal kidney tissue. Additionally, positive expression is observed in 5/12 stomach tumors, 5/24 colorectal tumors, 3/8 pancreatic tumors and 1/3 lung tumors. Normal non-cancerous tissue expression is limited to stomach and small intestine.

(6) DNA176766 (TAT132)

Positive signal in all endometrial adenocarcinomas tested (n=3) while no expression observed in normal endometrial tissue.

(7) DNA236463 (TAT150)

Positive signal in all endometrial adenocarcinomas tested (n=3) while no expression observed in normal endometrial tissue.

(8) DNA 181162 (TAT129)

Neoplastic prostate epithelia are generally positive, with signal intensities varying from weak to strong between cases. Non-prostatic tissues are negative.

(9) DNA188221 (TAT111)

Strong signal seen in colonic multi-tumor array over malignant epithelium. In normal tissues, a certain probe gave specific signal over epithelial cells lining the lower 2/3 of the colonic crypts, the intensity of signal appeared significantly lower than in the colonic carcinomas. Positive expression is observed in 12/18 colorectal adenocarcinomas, 6/8 metastatic adenocarcinomas and 2/9 gastric adenocarcinomas.

(10) DNA233876 (TAT146)

Strong signal seen in colonic multi-tumor array over malignant epithelium. In normal tissues, a certain probe gave specific signal over epithelial cells lining the lower 2/3 of the colonic crypts, the intensity of signal appeared significantly lower than in the colonic carcinomas. Positive expression is observed in 12/18 colorectal adenocarcinomas, 6/8 metastatic adenocarcinomas and 2/9 gastric adenocarcinomas.

(11) DNA210499 (TAT123)

In one analysis, 12/14 ovarian adenocarcinomas are positive and 8/9 endometrial adenocarcinomas are positive. Normal ovarian stroma is negative as is uterine myometrium. Other normal ovarian and uterine tissues are negative.

In an independent analysis, 16/27 non small cell lung carcinomas are positive, wherein the signal is moderate or strong.

(12) DNA219894 (TAT211)

In one analysis, 12/14 ovarian adenocarcinomas are positive and 8/9 endometrial adenocarcinomas are positive. Normal ovarian stroma is negative as is uterine myometrium. Other normal ovarian and uterine tissues are negative.

In an independent analysis, 16/27 non small cell lung carcinomas are positive, wherein the signal is moderate or strong.

(13) DNA215609 (TAT113)

Strong signal seen in colonic carcinomas, with only very low level signal in normal colon. Lung and breast carcinomas were negative.

(14) DNA220432 (TAT128)

The only normal adult tissue expressing this gene is prostatic epithelium. The expression is of moderate to strong intensity and focal, it is more prevalent in hyperplastic epithelium.

In one analysis where 50 cases of primary prostate cancer are available for review, 29 cases (58%) are positive, 18 cases (36%) are negative and 3 cases (6%) are equivocal. In another analysis where 37 cases of primary prostate cancer are available for review, 33 cases (89%) are positive, 4 cases (11%) are negative. Finally, in another independent analysis where 27 cases of metastatic prostate cancer are available for review, 14 cases (52%) are positive, 11 cases (41%) are negative and 2 cases (7%) are equivocal.

(15) DNA226237 (TAT117)

In one analysis, two of 3 renal cell carcinomas are positive, wherein normal kidney expression is negative.

(16) DNA246450 (TAT168)

In one analysis, two of 3 renal cell carcinomas are positive, wherein normal kidney expression is negative.

(17) DNA227087 (TAT163)

A probe for this molecule showed a positive signal in a subpopulation of tumor-associated stromal cells in all tested cases of lung, breast, colon, pancreatic and endometrial carcinomas. The intensity of the labeling was often quite strong. In a case of colon adenocarcinoma with adjacent benign colon, labeling was restricted to the tumor-associated stroma and the normal benign tissue was negative. A breast fibroadenoma also showed labeling of subepithelial stromal cells.

(18) DNA266307 (TAT227)

A probe for this molecule showed a positive signal in a subpopulation of tumor-associated stromal cells in all tested cases of lung, breast, colon, pancreatic and endometrial carcinomas. The intensity of the labeling was often quite strong. In a case of colon adenocarcinoma with adjacent benign colon, labeling was restricted to the tumor-associated stroma and the normal benign tissue was negative. A breast fibroadenoma also showed labeling of subepithelial stromal cells.

(19) DNA266311 (TAT228)

A probe for this molecule showed a positive signal in a subpopulation of tumor-associated stromal cells in all tested cases of lung, breast, colon, pancreatic and endometrial carcinomas. The intensity of the labeling was often quite strong. In a case of colon adenocarcinoma with adjacent benign colon, labeling was restricted to the tumor-associated stroma and the normal benign tissue was negative. A breast fibroadenoma also showed labeling of subepithelial stromal cells.

(20) DNA266312 (TAT229)

A probe for this molecule showed a positive signal in a subpopulation of tumor-associated stromal cells in all tested cases of lung, breast, colon, pancreatic and endometrial carcinomas. The intensity of the labeling was often quite strong. In a case of colon adenocarcinoma with adjacent benign colon, labeling was restricted to the tumor-associated stroma and the normal benign tissue was negative. A breast fibroadenoma also showed labeling of subepithelial stromal cells.

(21) DNA266313 (TAT230)

A probe for this molecule showed a positive signal in a subpopulation of tumor-associated stromal cells in all tested cases of lung, breast, colon, pancreatic and endometrial carcinomas. The intensity of the labeling was often quite strong. In a case of colon adenocarcinoma with adjacent benign colon, labeling was restricted to the tumor-associated stroma and the normal benign tissue was negative. A breast fibroadenoma also showed labeling of subepithelial stromal cells.

(22) DNA227224 (TAT121)

Expression is seen in 2 of 3 endometrial adenocarcinomas.

(23) DNA247486 (TAT183)

Expression is seen in 2 of 3 endometrial adenocarcinomas.

(24) DNA227800 (TAT131)

In one analysis, 46/64 primary prostate cancers are positive and 6/14 metastatic prostate cancers are positive. Weak to moderate expression is seen in prostate epithelium

(25) DNA228199 (TAT127)

Expression is observed in 13 of 15 ovarian tumors (adenocarcinoma and surface epithelial tumors). Benign ovarian surface epithelium is also positive. The expression level in most positive tumors is strong or moderate and fairly uniform. Expression is also observed in 8 of 9 uterine adenocarcinomas. Seven of 23 non small cell lung carcinomas are positive.

(26) DNA228201 (TAT116)

The malignant cells of 13/16 colorectal adenocarcinomas are positive for TAT116 expression. Additionally, 9/10 metastatic adenocarcinomas are positive for expression. Expression is also observed in the basal portions of normal colonic crypts.

(27) DNA247488 (TAT189)

The malignant cells of 13/16 colorectal adenocarcinomas are positive for TAT189 expression. Additionally, 9/10 metastatic adenocarcinomas are positive for expression. Expression is also observed in the basal portions of normal colonic crypts.

(28) DNA236538 (TAT190)

The malignant cells of 13/16 colorectal adenocarcinomas are positive for TAT190 expression. Additionally, 9/10 metastatic adenocarcinomas are positive for expression. Expression is also observed in the basal portions of normal colonic crypts.

(29) DNA247489 (TAT191)

The malignant cells of 13/16 colorectal adenocarcinomas are positive for TAT191 expression. Additionally, 9/10 metastatic adenocarcinomas are positive for expression. Expression is also observed in the basal portions of normal colonic crypts.

(30) DNA228994 (TAT124)

Thirteen of 61 cass of non small cell lung carcinoma are positive for expression of TAT124. Expression level in these positive tumor samples is significantly higher than in normal adult tissues.

(31) DNA231542 (TAT100)

In situ analysis performed as described above evidences significantly upregulated expression in human glioma and glioblastoma tissues as compared to normal brain (and other) tissue.

(32) DNA231542-1 (TAT284)

In situ analysis performed as described above evidences significantly upregulated expression in human glioma and gliobalstoma tissues as compared to normal brain (and other) tissue.

(33) DNA231542-2 (TAT285)

In situ analysis performed as described above evidences significantly upregulated expression in human glioma and glioblastoma tissues as compared to normal brain (and other) tissue.

(34) DNA297393 (TAT285-1)

In situ analysis performed as described above evidences significantly upregulated expression in human glioma and glioblastoma tissues as compared to normal brain (and other) tissue.

(35) DNA236534 (TAT102)

Expression of TAT102 is seen in 14 of 15 ovarian epithelial malignancies (adenocarcinoma, epithelial surface tumors, endometrioid Ca). Also, 8 of 9 endometrial adenocarcinomas of the uterus express TAT102. Moreover, expression of TAT102 is seen in 24 of 27 non-small cell lung cancers, positive cases include squamous and adenocarcinomas. Expression in these tumor tissues is significantly higher than in their normal tissue counterparts.

(36) DNA246430 (TAT109)

Fourteen of 92 breast tumor samples are positive for TAT109 expression. Expression in all normal tissues is undetectable.

(37) DNA264454 (TAT106)

Expression of TAT106 is observed in 38/88 breast tumors. Expression in normal breast tissue is weak or undetectable.

(38) DNA98565 (TAT145)

Positive signal for TAT145 was observed in most gliomas, glioblastomas, some melanomas, and normal brain (primarily localized to astrocytes). The signal intensity in the glioblastomas appeared to be greater than that in normal astrocytes. While the majority of glioma and glioblastoma samples tested were positive for TAT145 expression, the majority of normal brain samples tested were negative for such expression.

(39) DNA246435 (TAT152)

Positive signal for TAT152 was observed in most glioblastomas, some melanomas, and normal brain (primarily localized to astrocytes). The signal intensity in the glioblastomas appeared to be greater than that in normal astrocytes. While the majority of glioma and glioblastoma samples tested were positive for TAT152 expression, the majority of normal brain samples tested were negative for such expression.

(40) DNA167234 (TAT130)

Seventy cases of primary adenocarcinoma of the prostate were available for review. Of these 70 cases, 56 cases (80%) are positive for TAT130 expression. TAT130 expression in non-prostatic tissues is weak or undetectable.

(41) DNA235621 (TAT166)

Seventy cases of primary adenocarcinoma of the prostate were available for review. Of these 70 cases, 56 cases (80%) are positive for TAT166 expression. TAT166 expression in non-prostatic tissues is weak or undetectable.

(42) DNA236493 (TAT141)

Positive expression is observed in 70/148 breast carcinomas, 2/63 colorectal adenocarcinomas, 4/42 ovarian tumors, 9/69 non small cell lung carcinomas, 9/67 prostate adenocarcinomas and 5/25 gliomas. Expression in normal non-cancerous tissues appears restricted to prostate and breast epithelium.

(43) DNA226094 (TAT164)

Twenty one of 37 glioblastoma samples and 8 or 8 glioma samples were positive for TAT164 expression while all other tumor and normal tissues examined (including normal brain tissue) were negative.

(44) DNA227578 (TAT165)

Fifteen of 25 glioblastoma samples tested were positive for expression while significantly weaker expression was observed in the normal brain samples tested.

Example 5

Immunohistochemistry Analysis

Antibodies against certain TAT polypeptides disclosed herein were prepared and immunohistochemistry analysis was performed as follows. Tissue sections were first fixed for 5 minutes in acetone/ethanol (frozen or paraffin-embedded). The sections were then washed in PBS and then blocked with avidin and biotin (Vector kit) for 10 minutes each followed by a wash in PBS. The sections were then blocked with 10% serum for 20 minutes and then blotted to remove the excess. A primary antibody was then added to the sections at a concentration of 10 µg/ml for 1 hour and then the sections were washed in PBS. A biotinylated secondary antibody (anti-primary antibody) was then added to the sections for 30 minutes and then the sections were washed with PBS. The sections were then exposed to the reagents of the Vector ABC kit for 30 minutes and then the sections were washed in PBS. The sections were then exposed to Diaminobenzidine (Pierce) for 5 minutes and then washed in PBS. The sections were then counterstained with Mayers hematoxylin, covered with a coverslip and visualized. Immunohistochemistry analysis can also be performed as described in Sambrook et al., *Molecular Cloning: A Laboratory Manual*, New York: Cold Spring Harbor Press, 1989 and Ausubel et al., *Current Protocols of Molecular Biology*, Unit 3.16, John Wiley and Sons (1997). The results from these analyses are show below.

(1) DNA96930 (TAT112)

Significantly higher expression was detected in the apical surface of the colonic crypts of colon tumors than on the apical surface of the normal colonic crypts. Additionally, TAT112 was found to be significantly overexpressed in pancreatic adenocarcinoma cells as compared to normal pancreatic cells. Finally, IHC analysis performed as described above evidenced that TAT112 is significantly overexpressed in lung carcinoma as compared to normal lung tissue, non small cell lung carcinoma as compared to normal lung tissue and stomach carcinoma as compared to normal stomach tissue.

(2) DNA226539 (TAT126)

Positive expression is observed in 2/10 uterine adenocarcinomas, 9/17 ovarian adenocarcinomas and 2/20 non small cell lung carcinomas. Using this procedure, expression of TAT126 was not detectable in any normal tissue.

(3) DNA236511 (TAT151)

Positive expression is observed in 2/10 uterine adenocarcinomas, 9/17 ovarian adenocarcinomas and 2/20 non small cell lung carcinomas. Using this procedure, expression of TAT151 was not detectable in any normal tissue.

Example 6

Verification and Analysis of Differential TAT Polypeptide Expression by GEPIS

TAT polypeptides which may have been identified as a tumor antigen as described in one or more of the above Examples were analyzed and verified as follows. An expressed sequence tag (EST) DNA database (LIFESEQ®, Incyte Pharmaceuticals, Palo Alto, Calif.) was searched and interesting EST sequences were identified by GEPIS. Gene expression profiling in silico (GEPIS) is a bioinformatics tool developed at Genentech, Inc. that characterizes genes of interest for new cancer therapeutic targets. GEPIS takes advantage of large amounts of EST sequence and library information to determine gene expression profiles. GEPIS is capable of determining the expression profile of a gene based upon its proportional correlation with the number of its occurrences in EST databases, and it works by integrating the LIFESEQ® EST relational database and Genentech proprietary information in a stringent and statistically meaningful way. In this example, GEPIS is used to identify and cross-validate novel tumor antigens, although GEPIS can be configured to perform either very specific analyses or broad screening tasks. For the initial screen, GEPIS is used to identify EST sequences from the LIFESEQ® database that correlate to expression in a particular tissue or tissues of interest (often a tumor tissue of interest). The EST sequences identified in this initial screen (or consensus sequences obtained from aligning multiple related and overlapping EST sequences obtained from the initial screen) were then subjected to a screen intended to identify the presence of at least one transmembrane domain in the encoded protein. Finally, GEPIS was employed to generate a complete tissue expression profile for the various sequences of interest. Using this type of screening bioinformatics, various TAT polypeptides (and their encoding nucleic acid molecules) were identified as being significantly overexpressed in a particular type of cancer or certain cancers as compared to other cancers and/or normal non-cancerous tissues. The rating of GEPIS hits is based upon several criteria including, for example, tissue specificity, tumor specificity and expression level in normal essential and/or normal proliferating tissues. The following is a list of molecules whose tissue expression profile as determined by GEPIS evidences high tissue expression and significant upregulation of expression in a specific tumor or tumors as compared to other tumor(s) and/or normal tissues and optionally relatively low expression in normal essential and/or normal proliferating tissues. As such, the molecules listed below are excellent polypeptide targets for the diagnosis and therapy of cancer in mammals.

| Molecule | upregulation of expression in: | as compared to: |
|---|---|---|
| DNA77507 (TAT161) | breast tumor | normal breast tissue |
| DNA77507 (TAT161) | colon tumor | normal colon tissue |
| DNA77507 (TAT161) | lung tumor | normal lung tissue |
| DNA77507 (TAT161) | kidney tumor | normal kidney tissue |
| DNA77507 (TAT161) | liver tumor | normal liver tissue |
| DNA77507 (TAT161) | ovarian tumor | normal ovarian tissue |
| DNA77507 (TAT161) | pancreatic tumor | normal pancreatic tissue |
| DNA77507 (TAT161) | rectum tumor | normal rectum tissue |
| DNA77507 (TAT161) | skin tumor | normal skin tissue |
| DNA77507 (TAT161) | uterine tumor | normal uterine tissue |
| DNA77507 (TAT161) | brain tumor | normal brain tissue |
| DNA77507 (TAT161) | soft tissue tumor | normal soft tissue |
| DNA77507 (TAT161) | bone tumor | normal bone tissue |
| DNA82343 (TAT157) | colon tumor | normal colon tissue |
| DNA82343 (TAT157) | ovarian tumor | normal ovarian tissue |
| DNA82343 (TAT157) | stomach tumor | normal stomach tissue |
| DNA82343 (TAT157) | thymus tumor | normal thymus tissue |
| DNA82343 (TAT157) | small intestine tumor | normal small intestine tissue |
| DNA87994 (TAT160) | breast tumor | normal breast tissue |
| DNA87994 (TAT160) | pancreatic tumor | normal pancreatic tissue |
| DNA87994 (TAT160) | colon tumor | normal colon tissue |
| DNA87994 (TAT160) | esophagus tumor | normal esophagus tissue |
| DNA87994 (TAT160) | ovarian tumor | normal ovarian tissue |
| DNA87994 (TAT160) | prostate tumor | normal prostate tissue |
| DNA88131 (TAT158) | breast tumor | normal breast tissue |
| DNA88131 (TAT158) | colon tumor | normal colon tissue |
| DNA88131 (TAT158) | lung tumor | normal lung tissue |
| DNA88131 (TAT158) | pancreatic tumor | normal pancreatic tissue |
| DNA88131 (TAT158) | prostate tumor | normal prostate tissue |
| DNA88131 (TAT158) | stomach tumor | normal stomach tissue |
| DNA88131 (TAT158) | bladder tumor | normal bladder tissue |
| DNA88131 (TAT158) | brain tumor | normal brain tissue |
| DNA95930 (TAT110) | colon tumor | normal colon tissue |
| DNA95930 (TAT110) | lung tumor | normal lung tissue |
| DNA95930 (TAT110) | prostate tumor | normal prostate tissue |
| DNA95930 (TAT110) | endometrial tumor | normal endometrial tissue |
| DNA95930 (TAT110) | ovarian tumor | normal ovarian tissue |
| DNA95930 (TAT110) | breast tumor | normal breast tissue |
| DNA95930-1 (TAT210) | colon tumor | normal colon tissue |
| DNA95930-1 (TAT210) | lung tumor | normal lung tissue |
| DNA95930-1 (TAT210) | prostate tumor | normal prostate tissue |
| DNA95930-1 (TAT210) | endometrial tumor | normal endometrial tissue |
| DNA95930-1 (TAT210) | ovarian tumor | normal ovarian tissue |
| DNA95930-1 (TAT210) | breast tumor | normal breast tissue |
| DNA96917 (TAT159) | pancreatic tumor | normal pancreatic tissue |
| DNA96917 (TAT159) | lung tumor | normal lung tissue |
| DNA96917 (TAT159) | liver tumor | normal liver tissue |
| DNA96917 (TAT159) | prostate tumor | normal prostate tissue |
| DNA96930 (TAT112) | breast tumor | normal breast tissue |
| DNA96930 (TAT112) | colon tumor | normal colon tissue |
| DNA96930 (TAT112) | lung tumor | normal lung tissue |
| DNA96930 (TAT112) | ovarian tumor | normal ovarian tissue |
| DNA96930 (TAT112) | pancreatic tumor | normal pancreatic tissue |

-continued

| Molecule | upregulation of expression in: | as compared to: |
|---|---|---|
| DNA96930 (TAT112) | stomach tumor | normal stomach tissue |
| DNA96936 (TAT147) | breast tumor | normal breast tissue |
| DNA96936 (TAT147) | colon tumor | normal colon tissue |
| DNA96936 (TAT147) | prostate tumor | normal prostate tissue |
| DNA96936 (TAT147) | uterine tumor | normal uterine tissue |
| DNA98565 (TAT145) | brain tumor | normal brain tissue |
| DNA98565 (TAT145) | colon tumor | normal colon tissue |
| DNA246435 (TAT152) | brain tumor | normal brain tissue |
| DNA246435 (TAT152) | colon tumor | normal colon tissue |
| DNA98591 (TAT162) | colon tumor | normal colon tissue |
| DNA98591 (TAT162) | small intestine tumor | normal small intestine tissue |
| DNA98591 (TAT162) | ovarian tumor | normal ovarian tissue |
| DNA98591 (TAT162) | esophagus tumor | normal esophagus tissue |
| DNA108809 (TAT114) | colon tumor | normal colon tissue |
| DNA108809 (TAT114) | lung tumor | normal lung tissue |
| DNA108809 (TAT114) | ovarian tumor | normal ovarian tissue |
| DNA108809 (TAT114) | brain tumor | normal brain tissue |
| DNA143493 (TAT103) | breast tumor | normal breast tissue |
| DNA167234 (TAT130) | prostate tumor | normal prostate tissue |
| DNA235621 (TAT166) | prostate tumor | normal prostate tissue |
| DNA176766 (TAT132) | kidney tumor | normal kidney tissue |
| DNA176766 (TAT132) | uterine tumor | normal uterine tissue |
| DNA236463 (TAT150) | kidney tumor | normal kidney tissue |
| DNA236463 (TAT150) | uterine tumor | normal uterine tissue |
| DNA181162 (TAT129) | prostate tumor | normal prostate tissue |
| DNA188221 (TAT111) | colon tumor | normal colon tissue |
| DNA188221 (TAT111) | liver tumor | normal liver tissue |
| DNA188221 (TAT111) | lung tumor | normal lung tissue |
| DNA233876 (TAT146) | colon tumor | normal colon tissue |
| DNA233876 (TAT146) | liver tumor | normal liver tissue |
| DNA233876 (TAT146) | lung tumor | normal lung tissue |
| DNA193891 (TAT148) | prostate tumor | normal prostate tissue |
| DNA193891 (TAT148) | breast tumor | normal breast tissue |
| DNA248170 (TAT187) | breast tumor | normal breast tissue |
| DNA248170 (TAT187) | prostate tumor | normal prostate tissue |
| DNA194628 (TAT118) | kidney tumor | normal kidney tissue |
| DNA246415 (TAT167) | kidney tumor | normal kidney tissue |
| DNA215609 (TAT113) | colon tumor | normal colon tissue |
| DNA220432 (TAT128) | prostate tumor | normal prostate tissue |
| DNA226094 (TAT164) | breast tumor | normal breast tissue |
| DNA226094 (TAT164) | brain tumor | normal brain tissue |
| DNA226094 (TAT164) | ovarian tumor | normal ovarian tissue |
| DNA226094 (TAT164) | lung tumor | normal lung tissue |
| DNA226165 (TAT122) | breast tumor | normal breast tissue |
| DNA226165 (TAT122) | endometrial tumor | normal endometrial tissue |
| DNA226165 (TAT122) | lung tumor | normal lung tissue |
| DNA226165 (TAT122) | colon tumor | normal colon tissue |
| DNA226237 (TAT117) | kidney tumor | normal kidney tissue |
| DNA246450 (TAT168) | kidney tumor | normal kidney tissue |
| DNA246450 (TAT168) | brain tumor | normal brain tissue |
| DNA226456 (TAT144) | breast tumor | normal breast tissue |
| DNA226456 (TAT144) | brain tumor | normal brain tissue |
| DNA226456 (TAT144) | endometrial tumor | normal endometrial tissue |
| DNA226456 (TAT144) | kidney tumor | normal kidney tissue |
| DNA226456 (TAT144) | lung tumor | normal lung tissue |
| DNA237637 (TAT188) | breast tumor | normal breast tissue |
| DNA237637 (TAT188) | brain tumor | normal brain tissue |
| DNA237637 (TAT188) | endometrial tumor | normal endometrial tissue |
| DNA237637 (TAT188) | kidney tumor | normal kidney tissue |
| DNA237637 (TAT188) | lung tumor | normal lung tissue |
| DNA226539 (TAT126) | colon tumor | normal colon tissue |
| DNA226539 (TAT126) | endometrial tumor | normal endometrial tissue |
| DNA226539 (TAT126) | ovarian tumor | normal ovarian tissue |
| DNA226539 (TAT126) | pancreatic tumor | normal pancreatic tissue |
| DNA236511 (TAT151) | colon tumor | normal colon tissue |
| DNA236511 (TAT151) | endometrial tumor | normal endometrial tissue |
| DNA236511 (TAT151) | ovarian tumor | normal ovarian tissue |
| DNA236511 (TAT151) | pancreatic tumor | normal pancreatic |

-continued

| Molecule | upregulation of expression in: | as compared to: |
|---|---|---|
| DNA226771 (TAT115) | colon tumor | normal colon tissue |
| DNA227087 (TAT163) | breast tumor | normal breast tissue |
| DNA227087 (TAT163) | colon tumor | normal colon tissue |
| DNA227087 (TAT163) | endocrine tumor | normal endocrine tissue |
| DNA227087 (TAT163) | kidney tumor | normal kidney tissue |
| DNA227087 (TAT163) | liver tumor | normal liver tissue |
| DNA227087 (TAT163) | lung tumor | normal lung tissue |
| DNA227087 (TAT163) | pancreatic tumor | normal pancreatic tissue |
| DNA227087 (TAT163) | uterine tumor | normal uterine tissue |
| DNA227087 (TAT163) | prostate tumor | normal prostate tissue |
| DNA227087 (TAT163) | bladder tumor | normal bladder tissue |
| DNA266307 (TAT227) | breast tumor | normal breast tissue |
| DNA266307 (TAT227) | colon tumor | normal colon tissue |
| DNA266307 (TAT227) | endocrine tumor | normal endocrine tissue |
| DNA266307 (TAT227) | kidney tumor | normal kidney tissue |
| DNA266307 (TAT227) | liver tumor | normal liver tissue |
| DNA266307 (TAT227) | lung tumor | normal lung tissue |
| DNA266307 (TAT227) | pancreatic tumor | normal pancreatic tissue |
| DNA266307 (TAT227) | uterine tumor | normal uterine tissue |
| DNA266307 (TAT227) | prostate tumor | normal prostate tissue |
| DNA266307 (TAT227) | bladder tumor | normal bladder tissue |
| DNA266311 (TAT228) | breast tumor | normal breast tissue |
| DNA266311 (TAT228) | colon tumor | normal colon tissue |
| DNA266311 (TAT228) | endocrine tumor | normal endocrine tissue |
| DNA266311 (TAT228) | kidney tumor | normal kidney tissue |
| DNA266311 (TAT228) | liver tumor | normal liver tissue |
| DNA266311 (TAT228) | lung tumor | normal lung tissue |
| DNA266311 (TAT228) | pancreatic tumor | normal pancreatic tissue |
| DNA266311 (TAT228) | uterine tumor | normal uterine tissue |
| DNA266311 (TAT228) | prostate tumor | normal prostate tissue |
| DNA266311 (TAT228) | bladder tumor | normal bladder tissue |
| DNA266312 (TAT229) | breast tumor | normal breast tissue |
| DNA266312 (TAT229) | colon tumor | normal colon tissue |
| DNA266312 (TAT229) | endocrine tumor | normal endocrine tissue |
| DNA266312 (TAT229) | kidney tumor | normal kidney tissue |
| DNA266312 (TAT229) | liver tumor | normal liver tissue |
| DNA266312 (TAT229) | lung tumor | normal lung tissue |
| DNA266312 (TAT229) | pancreatic tumor | normal pancreatic tissue |
| DNA266312 (TAT229) | uterine tumor | normal uterine tissue |
| DNA266312 (TAT229) | prostate tumor | normal prostate tissue |
| DNA266312 (TAT229) | bladder tumor | normal bladder tissue |
| DNA266313 (TAT230) | breast tumor | normal breast tissue |
| DNA266313 (TAT230) | colon tumor | normal colon tissue |
| DNA266313 (TAT230) | endocrine tumor | normal endocrine tissue |
| DNA266313 (TAT230) | kidney tumor | normal kidney tissue |
| DNA266313 (TAT230) | liver tumor | normal liver tissue |
| DNA266313 (TAT230) | lung tumor | normal lung tissue |
| DNA266313 (TAT230) | pancreatic tumor | normal pancreatic tissue |
| DNA266313 (TAT230) | uterine tumor | normal uterine tissue |
| DNA266313 (TAT230) | prostate tumor | normal prostate tissue |
| DNA266313 (TAT230) | bladder tumor | normal bladder tissue |
| DNA227224 (TAT121) | breast tumor | normal breast tissue |
| DNA227224 (TAT121) | endometrial tumor | normal endometrial tissue |
| DNA227224 (TAT121) | lung tumor | normal lung tissue |
| DNA227224 (TAT121) | skin tumor | normal skin tissue |
| DNA247486 (TAT183) | breast tumor | normal breast tissue |
| DNA247486 (TAT183) | endometrial tumor | normal endometrial tissue |
| DNA247486 (TAT183) | lung tumor | normal lung tissue |
| DNA247486 (TAT183) | skin tumor | normal skin tissue |
| DNA227578 (TAT165) | brain tumor | normal brain tissue |
| DNA227800 (TAT131) | prostate tumor | normal prostate tissue |
| DNA227800 (TAT131) | kidney tumor | normal kidney tissue |
| DNA227904 (TAT140) | breast tumor | normal breast tissue |

-continued

| Molecule | upregulation of expression in: | as compared to: |
|---|---|---|
| DNA228199 (TAT127) | uterine tumor | normal uterine tissue |
| DNA228199 (TAT127) | fallopian tube tumor | normal fallopian tube tissue |
| DNA228199 (TAT127) | ovarian tumor | normal ovarian tissue |
| DNA228199 (TAT127) | lung tumor | normal lung tissue |
| DNA228201 (TAT116) | colon tumor | normal colon tissue |
| DNA247488 (TAT189) | colon tumor | normal colon tissue |
| DNA236538 (TAT190) | colon tumor | normal colon tissue |
| DNA247489 (TAT191) | colon tumor | normal colon tissue |
| DNA231312 (TAT143) | colon tumor | normal colon tissue |
| DNA231542 (TAT100) | brain tumor | normal brain tissue |
| DNA231542 (TAT100) | glioma | normal glial tissue |
| DNA231542-1 (TAT284) | brain tumor | normal brain tissue |
| DNA231542-1 (TAT284) | glioma | normal glial tissue |
| DNA231542-2 (TAT285) | brain tumor | normal brain tissue |
| DNA231542-2 (TAT285) | glioma | normal glial tissue |
| DNA297393 (TAT285-1) | brain tumor | normal brain tissue |
| DNA297393 (TAT285-1) | glioma | normal glial tissue |
| DNA232754 (TAT125) | lung tumor | normal lung tissue |
| DNA236246 (TAT153) | breast tumor | normal breast tissue |
| DNA236343 (TAT104) | breast tumor | normal breast tissue |
| DNA236493 (TAT141) | breast tumor | normal breast tissue |
| DNA236493 (TAT141) | glioblastoma tumor | normal glial tissue |
| DNA236534 (TAT102) | breast tumor | normal breast tissue |
| DNA236534 (TAT102) | lung tumor | normal lung tissue |
| DNA236534 (TAT102) | pancreatic tumor | normal pancreatic tissue |
| DNA236534 (TAT102) | prostate tumor | normal prostate tissue |
| DNA236534 (TAT102) | bladder tumor | normal bladder tissue |
| DNA247480 (TAT142) | lung tumor | normal lung tissue |
| DNA264454 (TAT106) | breast tumor | normal breast tissue |
| DNA264454 (TAT106) | prostate tumor | normal prostate tissue |
| DNA264454 (TAT106) | ovarian tumor | normal ovarian tissue |

Example 7

Use of TAT as a Hybridization Probe

The following method describes use of a nucleotide sequence encoding TAT as a hybridization probe for, i.e., diagnosis of the presence of a tumor in a mammal.

DNA comprising the coding sequence of full-length or mature TAT as disclosed herein can also be employed as a probe to screen for homologous DNAs (such as those encoding naturally-occurring variants of TAT) in human tissue cDNA libraries or human tissue genomic libraries.

Hybridization and washing of filters containing either library DNAs is performed under the following high stringency conditions. Hybridization of radiolabeled TAT-derived probe to the filters is performed in a solution of 50% formamide, 5×SSC, 0.1% SDS, 0.1% sodium pyrophosphate, 50 mM sodium phosphate, pH 6.8, 2× Denhardt's solution, and 10% dextran sulfate at 42° C. for 20 hours. Washing of the filters is performed in an aqueous solution of 0.1×SSC and 0.1% SDS at 42° C.

DNAs having a desired sequence identity with the DNA encoding full-length native sequence TAT can then be identified using standard techniques known in the art.

Example 8

Expression of TAT in *E. coli*

This example illustrates preparation of an unglycosylated form of TAT by recombinant expression in *E. coli*.

The DNA sequence encoding TAT is initially amplified using selected PCR primers. The primers should contain restriction enzyme sites which correspond to the restriction enzyme sites on the selected expression vector. A variety of expression vectors may be employed. An example of a suitable vector is pBR322 (derived from *E. coli*; see Bolivar et al., *Gene*, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the TAT coding region, lambda transcriptional terminator, and an argU gene.

The ligation mixture is then used to transform a selected *E. coli* strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized TAT protein can then be purified using a metal chelating column under conditions that allow tight binding of the protein.

TAT may be expressed in *E. coli* in a poly-His tagged form, using the following procedure. The DNA encoding TAT is initially amplified using selected PCR primers. The primers will contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences are then ligated into an expression vector, which is used to transform an *E. coli* host based on strain 52 (W3110 fuhA(tonA) lon galE rpoHts(htpRts) clpP(lacIq). Transformants are first grown in LB containing 50 mg/ml carbenicillin at 30° C. with shaking until an O.D.600 of 3-5 is reached. Cultures are then diluted 50-100 fold into CRAP media (prepared by mixing 3.57 g $(NH_4)_2SO_4$, 0.71 g sodium citrate-2H20, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20-30 hours at 30° C. with shaking. Samples are removed to verify expression by SDS-PAGE analysis, and the bulk culture is centrifuged to pellet the cells. Cell pellets are frozen until purification and refolding.

*E. coli* paste from 0.5 to 1 L fermentations (6-10 g pellets) is resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution is stirred overnight at 4° C. This step results in a denatured protein with all cysteine residues blocked by sulfitolization. The solution is centrifuged at 40,000 rpm in a Beckman Ultracentifuge for 30 min. The supernatant is diluted with 3-5 volumes of metal chelate column buffer (6 M guanidine, 20 mM Tris, pH 7.4) and filtered through 0.22 micron filters to clarify. The clarified extract is loaded onto a 5 ml Qiagen Ni-NTA metal chelate column equilibrated in the metal chelate column buffer. The column is washed with additional buffer containing 50 mM imidazole (Calbiochem, Utrol grade), pH 7.4. The protein is eluted with buffer containing 250 mM imidazole. Fractions containing the desired protein are pooled and stored at 4° C. Protein concentration is estimated by its absorbance at 280 nm using the calculated extinction coefficient based on its amino acid sequence.

The proteins are refolded by diluting the sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes are chosen so that the final protein concentration is between 50 to 100 micrograms/ml. The refolding solution is stirred gently at 4° C. for 12-36 hours. The refolding reaction is quenched by the addition of TFA to a final concentration of 0.4% (pH of approximately 3). Before further purification of the protein, the solution is filtered through a 0.22 micron filter and acetonitrile is added to 2-10% final concentration. The refolded protein is chromatographed on a Poros R1/H reversed phase column using a mobile buffer of 0.1% TFA with elution with a gradient of acetonitrile from 10 to 80%. Aliquots of fractions with A280 absorbance are analyzed on SDS polyacrylamide gels and fractions containing homogeneous refolded protein are pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations. In addition to resolving misfolded forms of proteins from the desired form, the reversed phase step also removes endotoxin from the samples.

Fractions containing the desired folded TAT polypeptide are pooled and the acetonitrile removed using a gentle stream of nitrogen directed at the solution. Proteins are formulated into 20 mM Hepes, pH 6.8 with 0.14 M sodium chloride and 4% mannitol by dialysis or by gel filtration using G25 Superfine (Pharmacia) resins equilibrated in the formulation buffer and sterile filtered.

Certain of the TAT polypeptides disclosed herein have been successfully expressed and purified using this technique(s).

Example 9

Expression of TAT in Mammalian Cells

This example illustrates preparation of a potentially glycosylated form of TAT by recombinant expression in mammalian cells.

The vector, pRK5 (see EP 307,247, published Mar. 15, 1989), is employed as the expression vector. Optionally, the TAT DNA is ligated into pRK5 with selected restriction enzymes to allow insertion of the TAT DNA using ligation methods such as described in Sambrook et al., supra. The resulting vector is called pRK5-TAT.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 µg pRK5-TAT DNA is mixed with about 1 µg DNA encoding the VA RNA gene [Thimmappaya et al., *Cell*, 31:543 (1982)] and dissolved in 500 µl of 1 mM Tris-HCl, 0.1 mM EDTA, 0.227 M $CaCl_2$. To this mixture is added, dropwise, 50 µl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 µCi/ml $^{35}$S-cysteine and 200 µCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of TAT polypeptide. The cultures containing transfected cells may undergo further incubation (in serum free medium) and the medium is tested in selected bioassays.

In an alternative technique, TAT may be introduced into 293 cells transiently using the dextran sulfate method described by Somparyrac et al., *Proc. Natl. Acad. Sci.*, 12:7575 (1981). 293 cells are grown to maximal density in a spinner flask and 700 µg pRK5-TAT DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 µg/ml bovine insulin and 0.1 µg/ml bovine transferrin. After about four days, the conditioned media is centrifuged and filtered to remove cells and debris. The sample containing expressed TAT can then be concentrated and purified by any selected method, such as dialysis and/or column chromatography.

In another embodiment, TAT can be expressed in CHO cells. The pRK5-TAT can be transfected into CHO cells using known reagents such as CaPO$_4$ or DEAE-dextran. As described above, the cell cultures can be incubated, and the medium replaced with culture medium (alone) or medium containing a radiolabel such as 35S-methionine. After determining the presence of TAT polypeptide, the culture medium may be replaced with serum free medium. Preferably, the cultures are incubated for about 6 days, and then the conditioned medium is harvested. The medium containing the expressed TAT can then be concentrated and purified by any selected method.

Epitope-tagged TAT may also be expressed in host CHO cells. The TAT may be subcloned out of the pRK5 vector. The subclone insert can undergo PCR to fuse in frame with a selected epitope tag such as a poly-his tag into a Baculovirus expression vector. The poly-his tagged TAT insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged TAT can then be concentrated and purified by any selected method, such as by Ni$^{2+}$-chelate affinity chromatography.

TAT may also be expressed in CHO and/or COS cells by a transient expression procedure or in CHO cells by another stable expression procedure.

Stable expression in CHO cells is performed using the following procedure. The proteins are expressed as an IgG construct (immunoadhesin), in which the coding sequences for the soluble forms (e.g. extracellular domains) of the respective proteins are fused to an IgG1 constant region sequence containing the hinge, CH2 and CH2 domains and/or is a poly-His tagged form.

Following PCR amplification, the respective DNAs are subcloned in a CHO expression vector using standard techniques as described in Ausubel et al., *Current Protocols of Molecular Biology*, Unit 3.16, John Wiley and Sons (1997). CHO expression vectors are constructed to have compatible restriction sites 5' and 3' of the DNA of interest to allow the convenient shuttling of cDNA's. The vector used expression in CHO cells is as described in Lucas et al., *Nucl. Acids Res.* 24:9 (1774-1779 (1996), and uses the SV40 early promoter/enhancer to drive expression of the cDNA of interest and dihydrofolate reductase (DHFR). DHFR expression permits selection for stable maintenance of the plasmid following transfection.

Twelve micrograms of the desired plasmid DNA is introduced into approximately 10 million CHO cells using commercially available transfection reagents Superfect® (Qiagen), Dosper® or Fugene® (Boehringer Mannheim). The cells are grown as described in Lucas et al. supra. Approximately $3\times10^7$ ( cells are frozen in an ampule for further growth and production as described below.

The ampules containing the plasmid DNA are thawed by placement into water bath and mixed by vortexing. The contents are pipetted into a centrifuge tube containing 10 mLs of media and centrifuged at 1000 rpm for 5 minutes. The supernatant is aspirated and the cells are resuspended in 10 mL of selective media (0.2 µm filtered PS20 with 5% 0.2 µm diafiltered fetal bovine serum). The cells are then aliquoted into a 100 mL spinner containing 90 mL of selective media. After 1-2 days, the cells are transferred into a 250 mL spinner filled with 150 mL selective growth medium and incubated at 37° C. After another 2-3 days, 250 mL, 500 mL and mL spinners are seeded with $3\times10^5$ cells/mL. The cell media is exchanged with fresh media by centrifugation and resuspension in production medium. Although any suitable CHO media may be employed, a production medium described in U.S. Pat. No. 5,122,469, issued Jun. 16, 1992 may actually be used. A 3L production spinner is seeded at $1.2\times10^6$ cells/mL. On day 0, the cell number pH ie determined. On day 1, the spinner is sampled and sparging with filtered air is commenced. On day 2, the spinner is sampled, the temperature shifted to 33° C., and 30 mL of 500 g/L glucose and 0.6 mL of 10% antifoam (e.g., 35% polydimethylsiloxane emulsion, Dow Corning 365 Medical Grade Emulsion) taken. Throughout the production, the pH is adjusted as necessary to keep it at around 7.2. After 10 days, or until the viability dropped below 70%, the cell culture is harvested by centrifugation and filtering through a 0.22 µm filter. The filtrate was either stored at 4° C. or immediately loaded onto columns for purification.

For the poly-His tagged constructs, the proteins are purified using a Ni-NTA column (Qiagen). Before purification, imidazole is added to the conditioned media to a concentration of 5 mM. The conditioned media is pumped onto a 6 ml Ni-NTA column equilibrated in 20 mM Hepes, pH 7.4, buffer containing 0.3 M NaCl and 5 mM imidazole at a flow rate of 4-5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc-containing) constructs are purified from the conditioned media as follows. The conditioned medium is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 μL of 1 M Tris buffer, pH 9. The highly purified protein is subsequently desalted into storage buffer as described above for the poly-His tagged proteins. The homogeneity is assessed by SDS polyacrylamide gels and by N-terminal amino acid sequencing by Edman degradation.

Certain of the TAT polypeptides disclosed herein have been successfully expressed and purified using this technique(s).

Example 10

Expression of TAT in Yeast

The following method describes recombinant expression of TAT in yeast.

First, yeast expression vectors are constructed for intracellular production or secretion of TAT from the ADH2/GAPDH promoter. DNA encoding TAT and the promoter is inserted into suitable restriction enzyme sites in the selected plasmid to direct intracellular expression of TAT. For secretion, DNA encoding TAT can be cloned into the selected plasmid, together with DNA encoding the ADH2/GAPDH promoter, a native TAT signal peptide or other mammalian signal peptide, or, for example, a yeast alpha-factor or invertase secretory signal/leader sequence, and linker sequences (if needed) for expression of TAT.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant TAT can subsequently be isolated and purified by removing the yeast cells from the fermentation medium by centrifugation and then concentrating the medium using selected cartridge filters. The concentrate containing TAT may further be purified using selected column chromatography resins.

Certain of the TAT polypeptides disclosed herein have been successfully expressed and purified using this technique(s).

Example 11

Expression of TAT in Baculovirus-Infected Insect Cells

The following method describes recombinant expression of TAT in Baculovirus-infected insect cells.

The sequence coding for TAT is fused upstream of an epitope tag contained within a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the sequence encoding TAT or the desired portion of the coding sequence of TAT such as the sequence encoding an extracellular domain of a transmembrane protein or the sequence encoding the mature protein if the protein is extracellular is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4 -5 days of incubation at 28C, the released viruses are harvested and used for further amplifications. Viral infection and protein expression are performed as described by O'Reilley et al., *Baculovirus expression vectors: A Laboratory Manual,* Oxford: Oxford University Press (1994).

Expressed poly-his tagged TAT can then be purified, for example, by $Ni^{2+}$-chelate affinity chromatography as follows. Extracts are prepared from recombinant virus-infected Sf9 cells as described by Rupert et al., *Nature,* 362:175-179 (1993). Briefly, Sf9 cells are washed, resuspended in sonication buffer (25 mL Hepes, pH 7.9; 12.5 mM $MgCl_2$; 0.1 mM EDTA; 10% glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% glycerol, pH 7.8) and filtered through a 0.45 μm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% glycerol, pH 6.0), which elutes nonspecifically bound protein. After reaching $A_{280}$ baseline again, the column is developed with a 0 to 500 mM Imidazole gradient in the secondary wash buffer. One mL fractions are collected and analyzed by SDS-PAGE and silver staining or Western blot with $^2$NNTA-conjugated to alkaline phosphatase (Qiagen). Fractions containing the eluted $His_{10}$-tagged TAT are pooled and dialyzed against loading buffer.

Alternatively, purification of the IgG tagged (or Fc tagged) TAT can be performed using known chromatography techniques, including for instance, Protein A or protein G column chromatography.

Certain of the TAT polypeptides disclosed herein have been successfully expressed and purified using this technique(s).

Example 12

Preparation of Antibodies that Bind TAT

This example illustrates preparation of monoclonal antibodies which can specifically bind TAT.

Techniques for producing the monoclonal antibodies are known in the art and are described, for instance, in Goding, supra. Immunogens that may be employed include purified TAT, fusion proteins containing TAT, and cells expressing recombinant TAT on the cell surface. Selection of the immunogen can be made by the skilled artisan without undue experimentation.

Mice, such as Balb/c, are immunized with the TAT immunogen emulsified in complete Freund's adjuvant and injected subcutaneously or intraperitoneally in an amount from 1-100 micrograms. Alternatively, the immunogen is emulsified in MPL-TDM adjuvant (Ribi Immunochemical Research, Hamilton, Mont.) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retroorbital bleeding for testing in ELISA assays to detect anti-TAT antibodies.

After a suitable antibody titer has been detected, the animals "positive" for antibodies can be injected with a final intravenous injection of TAT. Three to four days later, the mice are sacrificed and the spleen cells are harvested. The spleen cells are then fused (using 35% polyethylene glycol) to a selected murine myeloma cell line such as P3X63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against TAT. Determination of "positive" hybridoma cells secreting the desired monoclonal antibodies against TAT is within the skill in the art.

The positive hybridoma cells can be injected intraperitoneally into syngeneic Balb/c mice to produce ascites containing the anti-TAT monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

Antibodies directed against certain of the TAT polypeptides disclosed herein have been successfully produced using this technique(s). More specifically, functional monoclonal antibodies that are capable of recognizing and binding to TAT protein (as measured by standard ELISA, FACS sorting analysis and/or immunohistochemistry analysis) have been successfully generated against the following TAT proteins as disclosed herein: TAT110 (DNA95930), TAT210 (DNA95930-1), TAT113 (DNA215609), TAT126 (DNA226539), TAT151 (DNA236511), TAT111 (DNA188221), TAT146 (DNA233876), TAT112 (DNA96930), TAT145 (DNA98565), TAT152 (DNA246435), TAT141 (DNA236493), TAT114 (DNA108809), TAT104 (DNA236343), TAT100 (DNA231542), TAT284 (DNA231542-1), TAT285 (DNA231542-2), TAT285-1 (DNA297393), TAT144 (DNA226456), TAT188 (DNA237637), TAT123 (DNA210499), TAT211 (DNA219894), TAT102 (DNA236534), TAT127 (DNA228199) and TAT128 (DNA220432). Interestingly, Applicants have identified that the monoclonal antibodies prepared against TAT111 (DNA188221) and TAT146 (DNA233876) are capable of blocking activation of the EphB2R receptor encoded by the DNA188221 and DNA233876 molecules by its associated ligand polypeptide. As such, antibodies and methods for using those antibodies for blocking activation of the EphB2R receptor (i.e., TAT111 and TAT146 polypeptides) by its associated ligand are encompassed within the presently described invention. Moreover, Applicants have identified that monoclonal antibodies directed against the TAT110 (DNA95930) and TAT210 (DNA95930-1) polypeptides (i.e., IL-20 receptor alpha polypeptides) are capable of inhibiting activation of the IL20 receptor alpha by IL-19 protein. As such, antibodies and methods for using those antibodies for inhibiting activation of the IL-20 receptor alpha (i.e., TAT110 and TAT210 polypeptides) by IL-19 are encompassed within the presently described invention.

In addition to the successful preparation of monoclonal antibodies directed against the TAT polypeptides as described herein, many of those monoclonal antibodies have been successfully conjugated to a cell toxin for use in directing the cellular toxin to a cell (or tissue) that expresses a TAT polypeptide of interested (both in vitro and in vivo). For example, toxin (e.g., DM1) derivitized monoclonal antibodies have been successfully generated to the following TAT polypeptides as described herein: TAT110 (DNA95930), TAT210 (DNA95930-1), TAT112 (DNA96930), TAT113 (DNA215609), TAT111 (DNA188221) and TAT146 (DNA233876).

Example 13

Purification of TAT Polypeptides Using Specific Antibodies

Native or recombinant TAT polypeptides may be purified by a variety of standard techniques in the art of protein purification. For example, pro-TAT polypeptide, mature TAT polypeptide, or pre-TAT polypeptide is purified by immunoaffinity chromatography using antibodies specific for the TAT polypeptide of interest. In general, an immunoaffinity column is constructed by covalently coupling the anti-TAT polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of TAT polypeptide by preparing a fraction from cells containing TAT polypeptide in a soluble form. This preparation is derived by solubilization of the whole cell or of a subcellular fraction obtained via differential centrifugation by the addition of detergent or by other methods well known in the art. Alternatively, soluble TAT polypeptide containing a signal sequence may be secreted in useful quantity into the medium in which the cells are grown.

A soluble TAT polypeptide-containing preparation is passed over the immunoaffinity column, and the column is washed under conditions that allow the preferential absorbance of TAT polypeptide ( e.g., high ionic strength buffers in the presence of detergent). Then, the column is eluted under conditions that disrupt antibody/TAT polypeptide binding (e.g., a low pH buffer such as approximately pH 2-3, or a high concentration of a chaotrope such as urea or thiocyanate ion), and TAT polypeptide is collected.

Example 14

In Vitro Tumor Cell Killing Assay

Mammalian cells expressing the TAT polypeptide of interest may be obtained using standard expression vector and cloning techniques. Alternatively, many tumor cell lines expressing TAT polypeptides of interest are publicly available, for example, through the ATCC and can be routinely identified using standard ELISA or FACS analysis. Anti-TAT polypeptide monoclonal antibodies (and toxin conjugated derivatives thereof) may then be employed in assays to determine the ability of the antibody to kill TAT polypeptide expressing cells in vitro.

For example, cells expressing the TAT polypeptide of interest are obtained as described above and plated into 96 well dishes. In one analysis, the antibody/toxin conjugate (or naked antibody) is included throughout the cell incubation for a period of 4 days. In a second independent analysis, the cells are incubated for 1 hour with the antibody/toxin conjugate (or naked antibody) and then washed and incubated in the absence of antibody/toxin conjugate for a period of 4 days. Cell viability is then measured using the CellTiter-Glo Luminescent Cell Viability Assay from Promega (Cat# G7571). Untreated cells serve as a negative control.

In one specific analysis, the ability of monoclonal antibodies directed against TAT112 (DNA96930) were analyzed for the ability to kill cells expressing that polypeptide. In one analysis, an expression vector called gD.NCA was prepared. The TAT112 polypeptide encoding sequences inserted into that vector are driven by an SV40 promoter and the vector also contains the SV40 early poly A signal. The gD.NCA vector was co-transfected into PC3 cells along with an SV40 vector that expresses Neo resistance in PC3 cells, and positive transformants were selected in 800 µg/ml G418. Positive clones were isolated in 96 well plates and analyzed by flow cytometry using an anti-TAT112 monoclonal antibody prepared as described above and called 3E6. Clone 3 was selected for the analysis as it was found to express a high level of TAT112 polypeptide on its surface. In a second independent analysis, the pancreatic cancer cell line, Hpaf II, was obtained from the ATCC and employed in the assay.

The results from the above described assay demonstrated that DM1-conjugated anti-TAT112 monocloonal antibodies were highly efficacious in killing both the TAT112 expressing PC3 cell line as well as the pancreatic cancer cell line Hpaf II as compared to the untreated negative controls.

Example 15

In Vivo Tumor Cell Killing Assay

To test the efficacy of unconjugated anti-TAT112 monoclonal antibodies, anti-TAT112 antibody was injected intraperitoneally into nude mice 24 hours prior to receiving PC3.gD.NCA clone 3 cells (obtained as described in Example 14 above) subcutaneously in the flank. Antibody injections continued twice per week for the remainder of the study. Tumor volume was measured twice per week.

To test the efficacy of DM1-conjugated anti-TAT112 antibody, PC3.gD.NCA clone 3 cells (obtained as described in Example 14 above) were inoculated into the flank of nude mice. When the tumors reached a mean volume of approximately 100 mm3, mice were treated with DM1-conjugated anti-TAT112 antibody intravenously either once or twice per week.

The results of the above analyses demonstrated that both the unconjugated anti-TAT112 as well as the DM1-conjugated anti-TAT112 antibody were highly efficacious in reducing tumor volume in this in vivo model. These analyses demonstrate that anti-TAT polypeptide monoclonal antibodies are efficacious for killing tumor cells that express a TAT polypeptide of interest.

Example 16

Northern Blot Analysis

Northern blot analysis was performed essentially as described by Sambrook et al., supra. Northern blot analysis using probes derived from DNA231542, DNA231542-1, DNA231542-2 and DNA297393 evidences significant upregulation of expression in human glioma tissue as compared to normal human brain tissue.

The foregoing written specification is considered to be sufficient to enable one skilled in the art to practice the invention. The present invention is not to be limited in scope by the construct deposited, since the deposited embodiment is intended as a single illustration of certain aspects of the invention and any constructs that are functionally equivalent are within the scope of this invention. The deposit of material herein does not constitute an admission that the written description herein contained is inadequate to enable the practice of any aspect of the invention, including the best mode thereof, nor is it to be construed as limiting the scope of the claims to the specific illustrations that it represents. Indeed, various modifications of the invention in addition to those shown and described herein will become apparent to those skilled in the art from the foregoing description and fall within the scope of the appended claims.

SEQUENCE LISTING (154 sequences)

SEQ ID NO: 1 - DNA, 1039 bp, Homo Sapien
ccaagaattcggcacgagggtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccacgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttac

SEQ ID NO: 2 - DNA, 5062 bp, Homo Sapien
cactaacgctcttcctagtccccgggccaactcggacagtttgctcatttattgcaacggtcaaggctggcttgtgccagaacggcgcgcgcgcgacgcacgcacacacacggggggaaacttttttaaaaatgaaaggctagaagagctcagcggcggcgcgggccgtgcgcgagggctccggagctgactcgccgaggcaggaaatccctccggtcgcgacgcccggccccgctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaacgaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacggtaattctgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacactctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggccccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgcacaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaatctcagttgattttctggattccccatctcaggccagagccaaggggcttcaggtccaggctgtgtttggctttcagggaggccctgtgccccttgacaactggcaggcaggctcccagggacacctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggactttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgtggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaaccaaaaaaaaaaaaaaaaaaa

SEQ ID NO: 3 - DNA, 1150 bp, Homo Sapien
ggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagattagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccataggaaggtttaccagtagaatccttgctaggttgatgtgggccatacattcctttaataaaccattgtgtacataaaaaaaaaaaaaaaaaaaaaaaaaaaaaaaaaaaaaaaaaaaaaaaaaaaaaaaaaaaaaaaaaaaaaaaaa

SEQ ID NO: 4 - DNA, 474 bp, Homo Sapien
ggggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccatccccagcacggtgattagtcccagagctcggctgccacctccaccggacacctcagacacgcttctgcagctgtgcctcggctcacaacacagattgactgctctgactttgactactcaaaattggcctaaaaattaaaagagctcgatattaaaaa

SEQ ID NO: 5 - DNA, 3226 bp, Homo Sapien
aatccatctgagaatatgctgccacaaataccctttttgctgctagtatccttgaacttggttcatggagtgttttacgctgaacgataccaaacgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggcccctctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacaccccacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaagcaacaaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacacaataaaataacatcaatagatttttaggctgaattaatttgaaagcagcaatttgctgttctcaaccattctttcaaggcttttcattcgacacaataaaataacatcaatagatttttagggatgggtggcttt

SEQ ID NO: 6 - DNA, 1750 bp, Homo Sapien
catgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaa

SEQ ID NO: 7 - DNA, 1841 bp, Homo Sapien
agcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaa

SEQ ID NO: 8 - DNA, 536 bp, Homo Sapien
gcttggtctagtgcccatttactctggactccggatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 9 - DNA, 2588 bp, Homo Sapien
  unsure 1940: unknown base
gaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggnttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgcataaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctaaaaaaaaaaaa

SEQ ID NO: 10 - DNA, 3963 bp, Homo Sapien
gacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgtcgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccaaaaaaaaaaaaaaaaaaaaaaaaaaaaaaaaaaaaaaaaaaaaaaaaaaaaga

SEQ ID NO: 11 - DNA, 3476 bp, Homo Sapien
gctctatgccgcctaccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggagaagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccttgcgctcccgccaccacaggaagtgacaacatgacgaggggtggtgctggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagccca

SEQ ID NO: 12 - DNA, 2558 bp, Homo Sapien
tgtggcactgcctgcgtacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaattgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgc

SEQ ID NO: 13 - DNA, 401 bp, Homo Sapien
agccagctcaggctacactatcccaggatcagcatggccgtccgccagtgggtaatcgccctggccttggctgccctccttgttgtggacagggaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaagatccagcccaaaaaaaaaagaaaaaa

SEQ ID NO: 14 - DNA, 1572 bp, Homo Sapien
cgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccctgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccgatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataata

SEQ ID NO: 15 - DNA, 2573 bp, Homo Sapien
tccacatccaggtctttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaattttctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccgggttagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccgtgttgcaggttcatggattacttctctataaaaaatatgtatttaccaaaaattttgtgacattccttctcccatctcttccttgacctgcattgtaaataggttcttcttgttctgagattcaatattgaatttttcctatgctattgacaataaaatattattgaactaca

SEQ ID NO: 16 - DNA, 1145 bp, Homo Sapien
gccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgacagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctaaaaa

SEQ ID NO: 17 - DNA, 5668 bp, Homo Sapien
gtcacttaggaaaaggtgtcctttcgggcagccgggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgacgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagggatccactgtatatcctggacaacaaccacacacatttgctgctcgtggacaatggctgtcatggacatcccactgtcgaagcaaagctccggaatcagctagagaagcatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccggatcgctgatgtgatcgctagcctggtggaggtggaggatgccccgacatcttctgccgtcaaggagaagctggtgcgctttttaccccgcacggtgtcccggctgtctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcaccgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttatttattatttttccattaaaaataatagctggctattatagaaaatttagaccatacagagatgtagaaagaacataaattgtccccattaccttaaggtaatcactgctaacaatttctggatggtttttcaagtctattttttttctatgtatgtctcaattctctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaatatcgatttattattaaaaccatttataaggctttttcataaatgtatagcaaataggaattattaacttgagcataagatatgagatacatgaacctgaactattaaaataaaatattatatttaaccctagtttaagaagaagtcaatatgcttatttaaatattatggatggtgggcagatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaataaatattatggatggtgaagggaatggtatagaattggagagattatcttactgaacacctgtagtcccagctttctctggaagtggtggtatttgagcaggatgtgcacaaggcaattgaaatgcccataattagtttctcagctttgaatacactataaactcagtggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacgccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcggcttggtttaatgagtgtgttcatgaaataaataatggaggaattgtcaaaaaaaaaaaaaaaaaaaaaaaaaaaaaaaaaaaaaaaaaaaaaaaaaaaaaaaaaaaaaaaaa

SEQ ID NO: 18 - DNA, 3740 bp, Homo Sapien
gaattcgcccttggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcattgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttaaaaaaaaaaaaaaaaaaaaaaaaaaaaaaaaaaaaaaaaaaaa

SEQ ID NO: 19 - DNA, 3809 bp, Homo Sapien
gcggcgggggcgaggtgaggtgttggcagtggaaaggggttcgggctcggggggcggggggacgcggagcggatggcccgcgccggccgcaggggcggataaaaagccgtcgcgctgcgggagtgggcgggagggagagggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaggagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctatgaaaccctgtacacacctagttcataatcctcataatttatcaacaaacacaaagaagtgtcttacttgagagtgagtgtgtgcgtgtgtgcgtgcacacatgtgcacgtttgtatgtgtggaaataaacataaatggggacgtgttggagaaggaaatacatagacctacaactttgagcatatagcagtgatgttttaggaactgaaatgtcacacttaataaagtcttcagcccagctacttccctgttttcgtggggagaagggggcctgattagaactgttctggttgtgtttggcgggaggggaataaattttgttcagtccttcttagtgaccaaactttaatttttaggaataacatattgacttactgaactgaagcattctgagttgaaaggagccccagaggaaaggagttctgtgttgctcacatgttaaaagcttgctcaccttcagagcagagggaatacctatcttcagatatccgcccattttcatctcttcattatagtcaaacagtgtgacttgagagtgttgctctggtgtctgtattctggcttatgaagattatttgaaaaagaactcttactacattgaaatgcagacttttaaaaatttaaatattggattaggcagtcaaaaaaccaaacaagcataaaaggtcagtaagttgtaatcttaaaagtaaaggtggaaaactcattataaatggaagaaaagttttgatttccttttttgtttgatgggcagtatgccatattatatccaaagttggtttaaaaaatacttccatcaactatttttatttaaaataaacatttgagggaagttaccaaggcagcttttttcctcaaaagtaacctgttcctctttggaacagcacattttaggggcatggttaatacctgagatttttactcagtaaacctgatggttaccgtgtgtaaaatatctttaagtaggattgaaggcctctgtggggaatataatgttaccaaagcctataaaaataaattttacatgttcttttttatgacagagagcagcactggttctgttattttttaaaatgaataactgatttcttgacaggtgtttagtatttcttccctcactgctgattcttggatagaaaccattctttatatttgatagactgttttcagaaaactcttatcaacaagtgtacaatagttatctaaaactgtacatttagaatggagcagtttaatactagatctcagaaatttgaaaaatagcaaagaagactggatttggaaagcatggtctacaattgcttgtcaattctgaagctatgaagaataaatgtttcagctttggattatgaaaccccgtttatgatttttaaaacacacttgaaataaaaatgattgaactaaattttggtccggtgacatcattttgcactgcatagcccattatacattgtaagtctttttgttttaatttattactgagagttttctgtgaagctacagcatatctaatcagagaatttctgatttgtttccttatactgtgattatgttatattaaggcatttgtagtgcagcttaagactgaatttatgctttttgtaaacatgatcggtgtaaatgtcttataaacattctggagtatgtataactttaatgaatgaaatttaatggacctgattaaaataaagggatttaatctttgttaaagtgaagttagtggaataaattacctactggaatatagtccaagtcactaaaggtttaatatttgcatttttgtgcttttattttctccttccattcataattatatacttgaaagtacatctgtagcctatgacttgagtctcttgaacttctaggaagaggcaaactacaaactactaggattctgatttcagatataggcattccagaatcttctctttacgagttcacctgctagtataatctccacaacttgaatggccttggttgttctgtaattgctgccaaaatcatcacaagctgtacgtcatcaaggctccctttgcactcccaagaagaactgttcattttaaacaaaagtgtatgtctttatttgtattggaaaatattgtctttaaattgtttcttgttgacacttcccacaatggaaaaattaccaaattaaacctgttttatggatggcagcttggagcatagcaagaatttggaggatttgaattccattcccagttctcattgcgttttgtttcttaaaactataataattggttactgttataaagtttaaaaggtggttttaatatgaatagcaaattctggtatattgtgactaacgcttaagaatgcctgtctttgagaggaaggtgttataatattaatcaacagtgccaaatacactgtgcatatctacaatttaatctttgaatgtttgttactggattagctccctcctccttctgtgtgatggtaccatgcatagagtcaatcaaatccttgtgatgttttgtatggactttgacaacatgtaactaatgtgtaaagcaagtttttatgattaaggaatcaaatttattgaattttattattgaaagttgaaacttaacatgtataaacaaaaaacaataaaataataaactattttcattgactataaaaaaaagcccacgcgtccgcc

SEQ ID NO: 20 - DNA, 1048 bp, Homo Sapien
gaggtgaggtgttggcagtggaaaggggttcgggctcggggggcggggggacgcggagcgatggcccgcgccggccgcaggggcggataaaaagccgtcgcgctgcgggagtgggcgggagggagagggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgca

SEQ ID NO: 21 - DNA, 3332 bp, Homo Sapien
ggggggcggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgtggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcaggggggtttaagtgccgtttgcaataatgtcgtcttatttatttagcggggtgaatattttatactgtaagtgagcaatcagagtataatgtttatggtgacaaaattaaagcctttcttatatgttt

SEQ ID NO: 22 - DNA, 3768 bp, Homo Sapien
aacaaaagctggagctccaccgcggtggcggccgctctagcccctggttcggcccacctctgaaggttccagaatcgatagtgaattcgtggggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccagaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttgggctcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccag

SEQ ID NO: 23 - DNA, 3800 bp, Homo Sapien
cgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggtcgac

SEQ ID NO: 24 - DNA, 853 bp, Homo Sapien
ccgccagctccttcggcaatgaacttctccaccagcagcagcagcttcgcctacgaccgggagttcctccgcaccctgcccggcttcctcatcgtggccgagatcgttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaacatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaaaaaaaaaaaaaaaaaaaaa

SEQ ID NO: 25 - DNA, 485 bp, Homo Sapien
gcccttggcaatgaacttctccaccagcagcagcagcttcgcctacgaccgggagttcctccgcaccctgcccggcttcctcatcgtggccgagatcgttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccaaagggc

SEQ ID NO: 26 - DNA, 2257 bp, Homo Sapien
  unsure 2159, 2231: unknown base
ggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcacctttgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagttgctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtacttggcttggttgctggaggtctggtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccgatctttgtatttttttaaatttgattcttttctttgcaatgctagcaaccagaatacataggggaactgtgggctaggcaaanaaaatagaaaaagtgtgaaaaacagtaaagttgggagaggagcatctattttcttaaagaaataaaacaccnaaaacaaaaaaaaaaaaaaaaaaaaa

SEQ ID NO: 27 - DNA, 1725 bp, Homo Sapien
gcccttctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagtttctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtgcttggcttggttgctggaggtctggtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacaagggc

SEQ ID NO: 28 - DNA, 2280 bp, Homo Sapien
cgggccaggtttccaggctcggccgccgcctccatcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctactgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctaaaaaaaaaaa

SEQ ID NO: 29 - DNA, 2366 bp, Homo Sapien
cagcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccatggcctccatgactttttcaaaaaaaaaaaaaaaaaaaaaaaaaaaaaaaaaaaaaaaaaaaaaaaaa

SEQ ID NO: 30 - DNA, 1633 bp, Homo Sapien
ggcgtgggagctgcctaggccgggccctgccagggagcaagtctgcatcgcagaggccagggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttccaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcaaaaaaaaaaaaaaaaaaaaaa

SEQ ID NO: 31 - DNA, 1589 bp, Homo Sapien
catctaaagcctcctcagccttctgagtcagcctgaaaggaacaggccgaactgctgtatgggctctactgccagtgtgacctcaccctctccagtcacccctcctcagttccagctatgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgcccttttctggtttgattcccgagagattagctttgaggcctgtcttacccagatgttctttattcatgccctctcagccattgaatccaccatcctgctggccatggcctttgaccgttatgtggccatctgccacccactgcgccatgctgcagtgctcaacaatacagtaacagcccagattggcatcgtggctgtggtccgcggatccctcttttttttcccactgcctctgctgatcaagcggctggccttctgccactccaatgtcctctcgcactcctattgtgtccaccaggatgtaatgaagttggcctatgcagacactttgcccaatgtggtatatggtcttactgccattctgctggtcatgggcgtggacgtaatgttcatctccttgtcctattttctgataatacgaacggttctgcaactgccttccaagtcagagcgggccaaggcctttggaacctgtgtgtcacacattggtgtggtactcgccttctatgtgccacttattggcctctcagttgtacaccgctttggaaacagccttcatcccattgtgcgtgttgtcatgggtgacatctacctgctgctgcctcctgtcatcaatcccatcatctatggtgccaaaaccaaacagatcagaacacgggtgctggctatgttcaagatcagctgtgacaaggacttgcaggctgtgggaggcaagtgacccttaacactacacttctccttatctttattggcttgataaacataattatttctaacactagcttatttccagttgcccataagcacatcagtacttttctctggctggaatagtaaactaaagtatggtacatctacctaaaggactattatgtggaataatacatactaatgaagtattacatgatttaaagactacaataaaaccaaacatgcttataacattaagaaaaacaataaagatacatgattgaaaccaagttgaaaaatagcatatgccttggaggaaatgtgctcaaattactaatgatttagtgttgtccctactttctctctcttttttctttcttttttttttattatggttagctgtcacatacaactttttttttttttgagatggggtctccagcctgggcaacagagcaagaccctgtctcaaagcataaaatggaataacatatcaaatgaaacagggaaaatgaagctgacaatttatgggagcca

SEQ ID NO: 32 - DNA, 7941 bp, Homo Sapien
cacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtggggggactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaaaaaaaaaaaaaaaaaaaaaaaaaaaaaaaaaaa

SEQ ID NO: 33 - DNA, 2755 bp, Homo Sapien
attgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaagagcggcccctcgggggccctacggcccctggctctgcctcctggtggccctcgccctggacgtcgtgagagtggactgtggccaggctcccctggaccctgtctacctgcatgtgacagccgcccgcccagcccagcccacactctggactgccaagctagaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggccccgctgctaccgctgcgtatcgagctcaccgacaccaccctcgagcaggtccgcggctggagggtacctggccctgctgaagggcctgcggaacccgctgcagaggcgtcagatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgtgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatctcattctaacagaataaaccgagaaggaaaccagaaaaaaaaaaaaaaaaaaa

SEQ ID NO: 34 - DNA, 1795 bp, Homo Sapien
acgcgtccgcccacgcgtccgcccacgcgtccggtcggggccagagcgcaggtgtacctggcggccgtgctggagcacctgaccgccgagatcctggagctggctggcaacccggcccgcgacaagaagacccgcatcatcctgcgccacctgtagctggccattcgcaacggcgaggagcttaacaagctgctgggcgaagtcaccatcgcgcagggcggtgtcctgcccaacattcagggcgtgcttctgccccagaagaccaagagccaccacaaggccaagggtgaaaaccattcactaggagaggagaaacacaatggccaccaagacagagttgagtcccacagcaagggagagcaagaacgcacaagatatgcaagtggatgagacactgatccccaggaaaggtccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccttttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagcggatttcttcttagtcaggaccctgagtttgggtggaggaatgtcttcttcttgctgtttgccgttaacctgttaggactactcttctacctcatatttggagaagcagatgtccaagaatgggctaaagagagaaaactcactcgtttatgaagttatcccaccttggatggaaaagtcattaggcaccgtattgcataaaatagaaggcttccgtgatgaaaataccagtgaaaagatttttttttcctgtggctcttttcaattatgagatcagttcattattttattcagacttttttttgagagaaatgtaagatgaataaaaattcaaataaaatgataactaagaaaaaaaaaaaaaaa

SEQ ID NO: 35 - DNA, 1795 bp, Homo Sapien; identical to SEQ ID NO: 34

SEQ ID NO: 36 - DNA, 4524 bp, Homo Sapien
gctcgctgggccgctgctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctgtgcgtgctgctgctcacggccgtgaactgctacagcgtgaaggccgccacccgggtccaggatgcctttgccgccgccaagctcctggccctggccctgatcatcctgctgggcttcgtccagatcggaaagggtgatgtgtccaatctagatcccaagttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgctttggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtcctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccagacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgttccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccaaggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccacctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccaggtccaggagaagtgctccctggaggcacggaccactgcttcccactggggccggcggggcccacgcacgacgtcagcctcttaccttcccgcctcggctaggggtcctcgggatgccgttctgttccaacctcctgttctgggaggtggacatgcctcaaggatacagggagccggcggcctctcgacggcacgcacttcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctag

SEQ ID NO: 37 - DNA, 1590 bp, Homo Sapien
attcgccctttgctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgaagggcg

SEQ ID NO: 38 - DNA, 2436 bp, Homo Sapien
ccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcacccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcgtgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtgatccccgttccaccccaagagaactcgcgctcagtaaacgggaacatgccccctgcagacacgtaaaaaaaaaaaaaaaaaa

SEQ ID NO: 39 - DNA, 1979 bp, Homo Sapien
tgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcgtgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtgatccccgttccaccccaagagaact

SEQ ID NO: 40 - DNA, 2456 bp, Homo Sapien
ataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcaaaaaaaaaaaaaa

SEQ ID NO: 41 - DNA, 3213 bp, Homo Sapien
agagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgttttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggttcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggttcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggttctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaa

SEQ ID NO: 42 - DNA, 2450 bp, Homo Sapien
cccttgagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaagggc

SEQ ID NO: 43 - DNA, 2276 bp, Homo Sapien
cccttgagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctataagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaagggc

SEQ ID NO: 44 - DNA, 2366 bp, Homo Sapien
cccttgagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaagggc

SEQ ID NO: 45 - DNA, 2360 bp, Homo Sapien
cccttgagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctataagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaagggc

SEQ ID NO: 46 - DNA, 2186 bp, Homo Sapien
acacggaccaaggagtctaacacgtgcgcgagtcgggggctcgcacgaaagccgccgtggcgcaatgaaggtgaaggccggcgcgctcgccggccgaggtgggatcccgaggcctctccagtccgccgagggcgcaccaccggcccgtctcgcccgccgcgccggggaggtggagcacgagcgcacgtgttaggacccgaaagatggtgaactatgcctgggcagggcgaagccagaggaaactctggtggaggtccgtagcggtcctgacgtgcaaatcggtcgtccgacctgggtataggggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttgggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacaaaaaaaaaa

SEQ ID NO: 47 - DNA, 851 bp, Homo Sapien
attcgcccttccgaaagatggtgaactatgcctgggcagggcgggctccaggcgaggcggtcgacgctcctgaaaacttgcgcgcgcgctcgcgccactgcgcccggagcgatgaagatggtcgcgccctggactcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagaagggc

SEQ ID NO: 48 - DNA, 1728 bp, Homo Sapien
agcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagtgccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcggggtagtgggtgggggtagggaagaaacattatctcctcttgtacagagtctatttcttgtaaccatttgttaaactc

SEQ ID NO: 49 - DNA, 4231 bp, Homo Sapien
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacatctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagggggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatatgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaaggagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctccc

SEQ ID NO: 50 - DNA, 2861 bp, Homo Sapien
ctccgtcccaggggagaaggagaggcgtctgcagggggcagagaccgcagctacctgccgggtgcgccccccacccaggagcgctcgcttcgccccctttcctccccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaatctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccacgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacagcatatttcgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaataaaaaaaaaaaaa

SEQ ID NO: 51 - DNA, 3557 bp, Homo Sapien
gagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggccactatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctccaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtctagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacccgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcttcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcg

SEQ ID NO: 52 - DNA, 3866 bp, Homo Sapien
gcccgggcaggtgctgatagcacagttctgtccagagaaggaaggcggaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcgttgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaattgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattatttttgctcatcaaaaaataaaggattttcttcttcacttgatgaatgagtcttttgttacttctttttgggctctccatttgggaaagaaaatctagaaagtatgctcattgtaattgaaattgtattataattgcaagtcagctatactgtcatcttgtattattctgttaaaagcgattgtgaaaacttgaactccatgttaggatgacttatttagtcaagaggagctctttatcactattaagggagtttattaatgtctagtttaaaaaataacaatttataattttcatagatttttgtggactcctacctatatcgctaaggaatcattcagctaataacataagcaaaatgccttcattctctatcagaatgctttttatttctgccatctacccaacctcggcctacaaggaccacactggctctgggatgttagtcgtcacagtgaatccctagaaggagagaagcccagggctcttaagagagaaacctcacacttcattgtgcccagacaattcaactcattatagattagaagaatggttgtactgaattagcattatattatctattttttctaccattaagtgaccacgaatgaacaaatggttgtttctaatagtttaggaacctctacggcttgagggataaaactgtttttggtttttttttgtcactagtctgagcacaataaaggtaggtcatgaactcatggtggctaatcatgtttcatttattacaacagtaaaacaatactgatggttgtttacatagggagggataccactgctgttgccaatttgttcacccggatttcagctaattcaggtttaataaggctttgggaaaatgcacaatgaaaccttgaagacatgattcttattagacaactactgaccaaatgacaacttcatcttcaatgaccttgatttggaatcttgaaacttacaacgagttcctaatgagaaaggcatcactcttggtctccatgtctaaatatattgacacactcacttcaagatatgatggctgccaaaatcaatatcccaaggcttgaatatttatgggagtaggcataaattcgtgattatattcatggtaatgaatataataaatcctatgcatagccaacatccaagttgaactggggatgagcaggatacacagaaagctcctcacctgctttgagcaagtttttcttgcaaagttgtaatatgaaataccttaatcaacaaatttcttataaatgtttatatgagtagaaaatccctcaatttcattgtcactcaaaaagttgattatct

SEQ ID NO: 53 - DNA, 1817 bp, Homo Sapien
cccttgggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggaag

SEQ ID NO: 54 - DNA, 1000 bp, Homo Sapien
gggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttagga

SEQ ID NO: 55 - DNA, 1665 bp, Homo Sapien
gggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggaag

SEQ ID NO: 56 - DNA, 2400 bp, Homo Sapien
ggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtccatgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatga

SEQ ID NO: 57 - DNA, 2967 bp, Homo Sapien
tagagatccctcgacctcgacccacgcgtccgaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaat

SEQ ID NO: 58 - DNA, 3032 bp, Homo Sapien
gatccattgtgctggcgcggattctttatcactggaaggaggaggagggggagagtcgctcccgccgggcgagcatggggcgcctggcctcgaggccgctgctgctggcgctcctgtcgttggctctttgccgagggcgtgtggtgagagtccccacagcgaccctggttcgagtggtgggcactgagctggtcatcccctgcaacgtcagtgactatgatggccccagcgagcaaaactttgactggagcttctcatctttggggagcagctttgtggagcttgcaagcacctgggaggtggggttcccagcccagctgtaccaggagcggctgcagaggggcgagatcctgttaaggcggactgccaacgacgccgtggagctccacataaagaacgtccagccttcagaccaaggccactacaaatgttcaacccccagcacagatgccactgtccagggaaactatgaggacacagtgcaggttaaagtgctggccgactccctgcacgtgggccccagcgcgcggcccccgccgagcctgagcctgcgggagggggagcccttcgagctgcgctgcaccgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccgacagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcatcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgccagtgataaagaatccgcgccagcacaatggatctcgagggatcttccatacctaccagttctgcgcctgcaggtc

SEQ ID NO: 59 - DNA, 2771 bp, Homo Sapien
cccacgcgtccgcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaagtgtgtccgcgtcttcagggccctgtagccccgcggccccacacccgcctccaccgccccggttccagccccaccaaggcccttggggagccccgagtccccaggcccacctctccccgcggccccacgacggcccgcccgccgctgtctacagcaacctgggggcctacaggcccacgcggctgcagctggagcagctgggcctggtgccgaggctgactccaacctggaggcccttcctgcaggcctcccctcacttctgaaggtcccatcccctgctgccctccgcaggcccagggctgggcactccctgagacccaaagacccacctcaacgacgagtggcgttgagccacttccctttgaaaagacactcaaaatcactgccatggttcaatgttcccaggccccaggccatccacttgccggcccccaccagttcttgggttccccgctctagtttgacctgtgcagcacattccagaaggttccaggggaggttgtggggcagctagaggacaaaatcatgaaaacagagtccctgtcttccagagatcatccggggctttaatattaatggcccccaaaactccgtaagaagcaggaaatgcagcccaagttttacaaatgggtaaacagaggcactgagagatagatggtagtttggtacttctggttcccagtgcccaggaatggtccactcccaagaaattcaggaaagaaagactgaggagaaggtgtgggaacattctggatgtttcgggagagttggggaaactcctcctcttaggaaaggctaatactagggtatccttgggcccaatgaattaggggtgaggccccagaacccgttatctatgagttgtatgggggagccatctgaagctgtagccaccagggatgcagctagctgaggagtttggggtgttgggttggacaaggcaggttagtagactcagattcttgcttcaaagagccttgggctggcctggaggtccctggagtctagactggacctaggagcttgagttgtcaggggccaggactggccccactgcagtgcccaggccagtcttgagcagcagggagggctcagctgtccccagatccaggtgcctctgaccagcctggtcacctcctgaggaataaatgctgaacctcacaagccccatcattcatttcttctcaattcacagtgcccctctttgtttctggggtggaactaggtcctgagggcacagcctagctgagtgcaaagaaatataggatgcttagaaagcatacaggaggggccaggcgtggtggctcatgcctgtaatcccagaactttgggatgccaaggtggttggattacctgagatcaggtggattacctggtctcgagaccagcctgaccaatatggtgaaaccccgtctctactaaaaatacaaaaattaggctgagacaggagaattgcttgaacccaggaagcagaggttgcaatgagctgagattgcatcactgcactccagcatgggcaacaaagcaagactccgtcacagaaaaaaaaaaaaaa

SEQ ID NO: 60 - DNA, 4060 bp, Homo Sapien
atggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtwtgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgcttatttttgtattggcaaagtatcaattaaactatatgtgttctttttcaa

SEQ ID NO: 61 - DNA, 5472 bp, Homo Sapien
gaaagacatacacacttcatgtaatgctacctgcaagtctccctagaaaagcagtttttgtaggtgaaaacaatgaagccaggtaatattgcaaggaggctgtaattttagcagacctaccaacaacactgatgtaggaagctcattattttaatttctggagccttttaattttttctttagaaagtgtataaataattgcagtgctgctttgcttccaaaactgggcagtgagttcaacaacaacgacaacaacagccgcagctcatcctggccgtcatggagtttcttgaaagaacgtatcttgtgaatgataaagctgccaagatgtatgctttcacactagaaagaaggagctgcaaatgaacacttcatagcaatgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtcacagatgctgcccacctcttaattgacctgaccagtttcctgctcagtctcttctccctgtggttgtcatcgaagcctccctctaagcggctgacatttggatggcaccgagcagagatccttggtgccctgctctccatcctgtgcatctgggtggtgactggcgtgctagtgtacctggcatgtgagcgcctgctgtatcctgattaccagatccaggcgactgtgatgatcatcgtttccagctgcgcagtggcggccaacattgtactaactgtggttttgcaccagagatgccttggccacaatcacaaggaagtacaagccaatgccagcgtcagagctgcttttgtgcatgcccttggagatctatttcagagtatcagtgtgctaattagtgcacttattatctactttaagccagagtataaaatagccgacccaatctgcacattcatcttttccatcctggtcttggccagcaccatcactatcttaaaggacttctccatcttactcatggaaggtgtgccaaagagcctgaattacagtggtgtgaaagagcttattttagcagtcgacggggtgctgtctgtgcacagcctgcacatctggtctctaacaatgaatcaagtaattctctcagctcatgttgctacagcagccagccgggacagccaagtggttcggagagaaattgctaaagcccttagcaaaagctttacgatgcactcactcaccattcagatggaatctccagttgaccaggaccccgactgccttttctgtgaagacccctgtgactagctcagtcacaccgtcagtttcccaaatttgacaggccaccttcaaacatgctgctatgcagtttctgcatcatagaaaataaggaaccaaaggaagaaattcatgtcatggtgcaatgcacattttatctatttatttagttccattcaccatgaaggaagaggcactgagatccatcaatcaattggattatatactgatcagtagctgtgttcaattgcaggaatgtgtatatagattattcctgagtggagccgaagtaacagctgtttgtaactatcggcaataccaaattcatctcccttccaataatgcatcttgagaacacataggtaaatttgaactcaggaaagtcttactagaaatcagtggaagggacaaatagtcacaaaattttaccaaaacattagaaacaaaaaataaggagagccaagtcaggaataaaagtgactctgtatgctaacgccacattagaacttggttctctcaccaagctgtaatgtgatttttttttctactctgaattggaaatatgtatgaatatacagagaagtgcttacaactaatttttatttacttgtcacattttggcaataaatccctcttatttctaaattctaacttgtttatttcaaaactttatataatcactgttcaaaaggaaatattttcacctaccagagtgcttaaacactggcaccagccaaagaatgtggttgtagagacccagaagtcttcaagaacagccgacaaaaacattcgagttgaccccaccaagttgttgccacagataatttagatatttacctgcaagaaggaataaagcagatgcaaccaattcattcagtccacgagcatgatgtgagcactgctttgtgctagacattgggcttagcattgaaactataaagaggaatcagacgcagcaagtgcttctgtgttctggtagcaactcaacactatctgtggagagtaaactgaagatgtgcaggccaacattctggaaatcctatgtcactgggtttggtttggaaacctggacttctgcatttttaaaagttacccagagatgcttctaaagatgagccatagtctagaagattgtcaaccacaggagttcattgagtgggacagctagayacatacattggcagctacaatagtatcatgaattgcaatgatgtagtggggtataaaaggaaagcgatggatattgccggatgggcatggccagtgatgtttcacgtcattgaggtgacagctctgctggactttgaattacatatggaggctctccaggaagacgaagaagagaaggacattctaggcaaaaagaagactaggcacaaggcacacttatgtttgtctgttagcttttagttgaaaaagcaaaatacatgatgcaaagaaacctctccacgctgtgatttttaaaactacatactttttgcaactttatggttatgagtattgtagagaacaggagataggtcttagatgatttttatgttgttgtcagactctagcaaggtactagaaacctagcaggcattaataattgttgaggcaatgactctgaggctatatctgggccttgtcattatttatcatttatatttgtatttttttctgaaatttgagggccaagaaaacattgactttgactgaggaggtcacatctgtgccatctctgcaaatcaatcagcaccactgaaataactacttagcattctgctgagctttccctgctcagtagagacaaatatactcatcccccacctcagtgagcttgtttaggcaaccaggattagagctgctcaggttcccaacgtctcctgccacatcgggttctcaaaatggaaagaatggtttatgccaaatcacttttcctgtctgaaggaccactgaatggttttgtttttccatattttgcataggacgccctaaagactaggtgacttggcaaacacacaagtgttagtataattctttgcttctgcttctttttgaaaatcatgtttagatttgattttaagtcagaaattcactgaatgtcaggtaatcattatggagggagatttgtgtgtcaaccaaagtaattgtcccatggccccagggtatttctgttgtttccctgaaattctgcttttttagtcagctagattgaaaactctgaacagtagatgtttatatggcaaaatgcaagacaatctataagggagattttaaggattttgagatgaaaaaacagatgctactcaggggctttatggaccatccatcaattctgaagttctgactctcccattaccctttccctggtgtggtcagaactccaggtcactggaagttagtggaatcatgtagttgaattctttacttcaagacattgtattctctccagctatcaaaacattaatgatcttttatgtcttttttttgttattgttatactttaagttctggggtacatgtgcggaacatgtaggtttgttacataggtatacatgtgccatggtggtttgctgcactcatcaacctgtcatctacattcttttatgtctgtctttcaaagcaacactctgttcttctgagtagtgaaatcaggtcaactttaccaccagcctccatttttaatatgcttcaccatcatccagcacctacttaagatttatctagggctctgtggtgatgttaggacccataaaagaaatttatgccttccatatgtttggttacagatgggaaatgggaatgttgaaggacatgaaagaaaggatgtttacacattaagcatcagttctgaagctagattgtctgagtttgaatcttagctcttccctttattagctctgtgacctcgagctagttacttaaatgctctgatcctctatttcctgatcagtgaaacctccctattcaaatgtgtgagagtttaataaattaggacacttaaaaatgttggagcagtgcatagcatgtagtgttcagtacatgttaaatgttgttttttattatgtacaaacatgtgtgggcacagaattttaaatcatctcaacttttgagaaattttgagttatcaacaccgttcccacaagacagtggcaaaattattggtgagaattaaacagctgtttctcagaggaagcaatggaggcttgctgggataaaggcatttactgagaggctgttacctagtgagagtgatgaattaattaaaatagtcgaatccctttctgactgtctctgaaagcttccgcttttatctttgaagagcagaattgtcaccccaaggacatttattaataaaaagaacaactgtccagtgcaatgaaggcaaagtcataggtctcccaagtcttaccccattcctgtgaaatatcaagttcttggcttttctctgtcatgtagcctcaactttctccgaccgggtgcatttctttctctggtttctaaattgccagtggcaaatttggatcacttacttaatatctgttaaattttgtgacccaacaaagtcttttagcactgtggtgtcaaaaagaaaaacacctcccaggcatatacattttatagattcctggagaatgttgctctccagctccatccccacccaatgaaatatgatccagagagtcttgcaaagagacaagcctcattttccacaattagctctaaagtgcctccaggaaatgattttctcagctcatctctctgtattccctgttttggatcacagggcaatctgtttaaatgactaattacagaaatcattaaaggcaccaagcaaatgtcatctctgaatacacacatcccaagctttacaaatcctgcctggcttgacagtgatgaggccacttaacagtccagcgcaggcggatgttaaaaaaaataaaaaggtgaccatctgcggtttagttttttaactttctgatttcacacttaacgtctgtcattctgttactgggcacctgtttaaattctattttaaaatgttaatgagtgttgtttaaaataaaatcaggaaagagagaaaaaaaaaaaaaaaaaaaa

SEQ ID NO: 62 - DNA, 5170 bp, Homo Sapien
gcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagacaattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtataagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctgtctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaacctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttggggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatgacaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgactccacctcttgcatcaaatcaatatctatttgttgagcacttattgattaagaccttgcatatgtctgtccattttgatttgagatacaactttttgtgtgggttgaatgacaaatcactccaaacaaaactgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacagggaaaaaaaaaaaaaaaaaaaaaaaaaaa

SEQ ID NO: 63 - DNA, 5563 bp, Homo Sapien
agcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacacgttaaagggtaccactacatcattgcaaatctggaatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcggcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaggaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatccgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaatcacagatcctaaggtaatataatataattttagtgcatttctcctcatcaggaatgctggaggtgcattttaagttttaataataagtgctagaatgaccaaattgcagactaattgtttccatattgtacttaaaatgagtttttaaaagtgaaaaagaaatgactatatacaatcaatgctatttattgtacctctgggcctactcttctaaaaattgtagcttatcgatttttctctgtcaagcttgaactaatgtaaataattgaaataatgtaaagttatattttcatgtttttatagatacaacatgacaagaatacataatgtaagagtatttcaactatggataatgttgattggataatgcacatctcagttacaagcagtactcatagtttaatatccatgtaacggtgcatcaatatattgctatataaatatgtctgtgtgcatataagtgaaaagtggtcaaacaagagtgatgacagctgtctaaaggtttttttattcattttatataaaaactgttatggaaagaccaaaatgtttatgaactattcttatgtaaatttacaattgtcctttactgtacttttttgtttacagtatagtaccttattttctgctgtgttaagtgggtgtcaaactccaagaagacatacactttctataacttctattgaagatattggaatttccaatttttcatgtgtactatgtcagaaaatgctttcgattttatttttaaatctaacatcggatggcttttccggagtgttgtaaaaacttcaatcatacataaaacatgttcttacaaaaggcaaagatctt

SEQ ID NO: 64 - DNA, 1460 bp, Homo Sapien
gccaacactggccaaaagggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttagatacttcttttaagtgggagtctcag

SEQ ID NO: 65 - DNA, 1304 bp, Homo Sapien
  unsure 1144-1145: unknown base
tcattccattaaacatatttctaaataatagtaagtggtactaacaaaataaataataatttaatagccttagaaataaatgactgtatacttatacaggttgaaaaaaactcggtaggaataagttacctttttgtttactaatgttggtttcaaaaatactcagattcattttagttggctgacatctggaagtagttaacaactaaccagtggacttcaacaatcatttgctcccaggcttcccccatcatcaccctcaccacatatcctgctaatatccaacaacaaacaaatatttaatattgaaatagcccattgcctgagaatgaacacaagctaaaatacatgcaagggtacttaatggaagccaaaccatgttctatacctaaggagaaaacatggacatgtagaatgcttttattcatgtattcaaaatcagaacaaatcagtgtatatcactagaacatcagatggaggataacacaagaagtgatacagatcagggttcacttctcttaccctctctctgttaggaccacattcctattttagccaaatgtttctggtacgggccatcttttcaccataaatggcattatgtttcaaatggctaaaagcttattatgggtatgctcaaaggagtaaaacccaattcacagagatgtggcttttctaaagaaccaaattaagggaatacttagtatctacaactaaagtattagtcattctgaggattatttgttgctttaagtattagctccctactacatccataacaccctacttactaaatttaattacacacaacttttcaagaattcgtattttatttgaagggaggtacctgtctactttatctacaataaaaacaaagggtattggctttctctaatccatgcaaactacaaattccatcgggagtcctacatcactaacagtggtatgaacaaaactaagaaagtacttcctatccacatgtgaatgttttaaaaaagtttttgccataaaacctaagtgtaatttagcataccacagtgctctgaagatgggtcattgacgatgtaccatttgtatataggtaatacacatgtaaatcactaattgttaattaaatataagaagtaggtttttatctttttannaaaaaaacaaaaaaggtgactccctttctcattctgttctgttgtattgcgtccaaaagttgtgtgtaatttttttaaggtccaagaaatgtaaagaaatttgttggaatacctgaatttctgtaaaaaaataaaaataaaaataagattttgttactt

SEQ ID NO: 66 - DNA, 3268 bp, Homo Sapien
gggaggctgtgccaggcgagccggaggggtgctccgcgctcccccgccctccttccgggagcgaggatgcagactctgaaactggtgctgctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactcatttttatttttttaaaaatcattccattaaacatatttctaaataatagtaagtggtactaacaaaataaataataatttaatagccttagaaataaatgactgtatacttatacaggttgaaaaaaactcggtaggaataagttacctttttgtttactaatgttggtttcaaaaatactcagattcattttagttggctgacatctggaagtagttaacaactaaccagtggacttcaacaatcatttgctcccaggcttcccccatcatcaccctcaccacatatcctgctaatatccaacaacaaacaaatatttaatattgaaatagcccattgcctgagaatgaacacaagctaaaatacatgcaagggtacttaatggaagccaaaccatgttctatacctaaggagaaaacatggacatgtagaatgcttttattcatgtattcaaaatcagaacaaatcagtgtatatcactagaacatcagatggaggataacacaagaagtgatacagatcagggttcacttctcttaccctctctctgttaggaccacattcctattttagccaaatgtttctggtacgggccatcttttcaccataaatggcattatgtttcaaatggctaaaagcatattatgggtatgctcaaaggagtaaaacccaattcacagagatgtggcttttctaaagaaccaaattaagggaatacttagtatctacaactaaagtattagtcattctgaggattatttgttgctttaagtattagctccctactacatccataacaccctacttactaaatttaattacacacaacttttcaagaattcgtattttatttgaagggaggtacctgtctactttatctacaataaaaacaaagggtattggctttctctaatccatgcaaactacaaattccatcgggagtcctacatcactaacagtggtatgaacaaaactaagaaagtacttcctatccacatgtgaatgttttaaaaaagtttttgccataaaacctaagtgtaatttagcataccacagtgctctgaagatgggtcattgacgatgtaccatttgtatataggtaatacacatgtaaatcactaattgttaattaaatataagaagtaggtttttatctttttaaaaaaaaaacaaaaaaggtgactccctttctcattctgttctgttgtattgcgtccaaaagttgtgtgtaatttttttaaggtccaagaaatgtaaagaaatttgttggaatacctgaatttctgtaaaaaaataaaaataaaaataagattttgttacttaaaa

SEQ ID NO: 67 - DNA, 3268 bp, Homo Sapien; identical to SEQ ID NO: 66

SEQ ID NO: 68 - DNA, 3268 bp, Homo Sapien; identical to SEQ ID NO: 66

SEQ ID NO: 69 - DNA, 1755 bp, Homo Sapien
caggcctctgaggctcccttgccgagggccccgagctgcagggacagtgagcagtgagtcccttgggcatcccgctcctgggcaggtcaccaataggtccccgcagttcccaatggaactgttccagtcctccccgaggcctccacttcaacctgtctgtgtctgcccaggcctggagttgtgtgaccctccccaccgcctggccttctccatgggggctggccttttctcggtggtgggcaccctgctgctgcccggcctggctgcgcttgtgcaggactggcgtcttctgcaggggctgggtgccctgatgagtggactcttgctgctcttttgggggttcccggccctgttccccgagtctccctgctggctgctggccacaggtcaggtagctcgagccaggaagatcctgtggcgctttgcagaagccagtggcgtgggccccggggacagttccttggaggagaactccctggctacagagctgaccatgctgtctgcacggagcccccagccccggtaccactccccactggggcttctgcgtacccgagtcacctggagaaacgggcttatcttgggcttcagctcgctggttggtggaggcatcagagctagcttccgccgcagcctggcacctcaggtgccgaccttctacctgccctacttcctggaggccggcctggaggcggcagccttggtcttcctgctcctgacggcagattgctgtggacgccgccccgtgctgctgctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggggggccgggctgggcctggtgctgggggccgggttcctgggccaggcagccggccccctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgctccccactcctgcggggccgcccccgccaggaccacctgcctctgctgccgccctccaactcctactgggccggccacacccccgagcagcactagtcctgcctggtggccctgggagccaggatgggaccaaagtcaaggcctggggcatggctgagtaccccagacgtctggtccagggcagacacattcctctcagaagcccgtgtctcagtgcaggtggagccgtggggacagcgtgaaggtgtctccagccaggccccaggcactgggaggccctgggtctccccccagccacacccagtaggtgtggaggataaaggcttctgtggaacttggcgtcctccctggttcttccctcaggccacacctggggcctggaagggtctcacctgtgcctgctccccacctctgggctcaccagcaaggagccagggtgtcagcggctgctccatagcccctgtccaggtagtggcagcccccggccgcctcctgccccagccaagcagggtggtatgggggcctggccctcaggtccctgccaggccaggcctcactggccccatccccctcatggtcagtgtggcagtgggcgcccgtcctgcatgaaagagactagcacg

SEQ ID NO: 70 - DNA, 4021 bp, Homo Sapien
agcggggcgggtccccgaagcccagtaccagacctcctgtgcgaagagtaacctgctcttcggactgataactggatggaatggcctttagaaagggagcatcttcagaatctgcagctgggatcagattgttcttttgttgaatcaactcagctctgccgagccagcatcttgctaagggttacaaaataaatgccatttgaacagtgccatctgtcatggaaaaacgtgagacgtttgtacaatgccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtraaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacaamaaaaaaaaaaaaaaa

SEQ ID NO: 71 - DNA, 3580 bp, Homo Sapien
gcccttcagaatctgcagctgggatcagattgttcttttgttgaatcaactcagctctgccgagccagcatcttgctaagggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgaagggc

SEQ ID NO: 72 - DNA, 1191 bp, Homo Sapien
tccaaccagattttcaccgctatgcctcctttcactctgggagtcttccagaggtcttgcactcgggagagcatgctcaggtttccccagctctacaaaatcacccagaatgccaaagacttcaacgtgaccagtggtcatgccactgcctgttgatttgttgaaaatattgtttacacgtatgttcttgttactgattgtcagaaagctggttttgagactgcagcttggactaaattcagtcatctggctgtctggggaagcatgctgaccagtctggtgttctttggcatctactcagccatctggtccaccattctcattgccccaaatatgagaggacagaagaatggtaccggtactgccaatggagatggaggaaggagacagaaagaaacagagcccagaccctagggaccaccagcatttgcagaatggataaacagccttcttcctaacaaaggaagcacagcaactgtgatcctgagctgtgcacacttctggttgggattatttctggtttctacttcctgtttgaagatgtggcatggagagtgaacaagctgctgcccaccacctggcatcacagccccagaactcagctatttccatgggaccacagcatctcatctctgggctgagccagaaagacccctactgaagtccagaggcacttttctgaaaggctctgctttgacctgaagtattttatctatcctcagtctcaggacactgttgatggaattaaggccaagcacatctgcaaaaaagacattgctggaggaggtgcaaagagctggaaaccaagtctccagtcctgggaaaagcagtggtatggaaaagcaatggaaagagcattttgaaaatgccattccactgttttctggcctttatgatttctgctgagaaatccactgttagtctgatggggtctccttcatagcaccaatgacctgaagagccttgttgaaggaagactccatctgatgactcagagcaagtattttttagtgtgttattgttattagcagaaagagggccataaaatacatggggcaagctgaatatatcttaggcaaaagaagaaaatattcaaattcttatgttattttatctaattattttatctctttttgtgtgtgacttataatgtgtgtattgtattaataaaagtatataaacatgtagttt

SEQ ID NO: 73 - DNA, 2752 bp, Homo Sapien
cattcccacccttccttctttaataagcaggagcgaaaaagacaaattccaaagaggattgttcagttcaagggaatgaagaattcagaataattttggtaaatggattccaatatcgggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattacgatgcgctgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtcttgaagtcattcagaagtggtttgaggtttctgttttttggtggtttttgtttgttttttttttttttcaccttaagggaggctttcatttcctcccgactgattgtcacttaaatcaaaatttaaaaatgaataaaaagacatacttctcagctgcaaatattatggagaattgggcacccacaggaatgaagagagaaagcagctccccaacttcaaaaccattttggtacctgacaacaagagcattttagagtaattaatttaataaagtaaattagtattgctgcaaatagctaaattatatttatttgaattgatggtcaagagattttccattttttttacagactgttcagtgtttgtcaagcttctggtctaatatgtactcgaaagactttccgcttacaatttgtagaaacacaaatatcgttttccatacagcagtgcctatatagtgactgattttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttctgaggagtctctttcagtttcattttttctcatcccatgacttccctccgatggt

SEQ ID NO: 74 - DNA, 1001 bp, Homo Sapien
agtatgaggcgcccaccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtga

SEQ ID NO: 75 - DNA, 2805 bp, Homo Sapien
cgggtctgatagtccctacctgtcaggactggtgttaggatgagataatgtttgtgaactgtaaacatatataaacgtgtgctactgtgagaactggaacaaagaagagagggagtgagagaaatcaagggagggctggggctgggaaagaacgaaaagggagtcgcgtatagaggagaggcgacagtcgcgagccacactttgcaatgaaactctttagactttctgccgggagagcggcccagacgcgccaggtctgtagcaggaggccgcgagggcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccggggcgcagacgcctgcagaccatcccagacgccggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgaagtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgagggaagcatttctaaaatgtatcccctttcggtccaacaacaggaaacctgactggggcagtgaaggaagggatggcacagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaaccagaagtcggcatttgtgaaaagtccctccagatttctatcactttggtctctaatttcccaagacttgtattttttttttatttcaaattataacacttttttttcccccagaagtgggtgtttcatgttgctactctggtgtgtcccaagatatcctaactggccagtgtaaatgctattctttctaaataagattatttggaaacttccttcaaactgcaggagggcgagctctgagggcacgagaagctaaaactagctgcttttgatgaaaaagagtgccagtctttggtcatctctaaacaaggcttatcaccaatggagacagaaaactctagttcaagagctgtacctcctttgaatcccagccctactcgaaataagtggtactatttccatttagcctttgagcaaatcacttaactcaaaggcgttgtggctctaagattaaacgacttt

SEQ ID NO: 76 - DNA, 2637 bp, Homo Sapien
gcggccgcggagcaagaagggcgccgcgtcgtgcggcccgcgcagcccccggagccatgggcaagtgcagcgggcgctgcacgctggtcgccttctgctgcctgcagctggtggctgcgctggagcggcagatctttgacttcctgggctaccagtgggctcccatcctagccaacttcctgcacatcatggcagtcatcctgggcatctttggcaccgtgcagtaccgctcccggtacctcatcctgtatgcagcctggctggtgctctgggttggctggaatgcatttatcatctgcttctacttggaggttggacagctgtcccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgctctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcgcccagcatcctgcccccctgtccaaaaacagcaggacatcaggcccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactcttttagacttctcatttaactcaattccctgagctagactgggattaaaattctcattttgcagtacattaaaactgatgcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctct

SEQ ID NO: 77 - DNA, 1829 bp, Homo Sapien
ggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcac

SEQ ID NO: 78 - DNA, 5746 bp, Homo Sapien
  unsure 5621, 5664: unknown base
ggccgcgggctctcgcggggcggcgacgccgcggggaggatgctgcttgccgcgcccgcgtcctcaccgtcctcccgggccgcctgctggggctttgttgtggcccggacgccgcgggccaccccctgaagtcgcctgccgccgccgccgccgcacctagcggacgggcgggcgggcgcgcgtgtgcccaggagtgcgcgcctgtcgcggtggtgggtgcaggactggacccacgggcccattgtgcgcccgcccgcggcagccaggaccatgtgggtgaacccggaggaggtgttgctggccaacgcgctgtggatcaccgagagggccaacccatacttcatcctgcagcggaggaagggccacgccggcgatggaggcggcggcggcggactggcgggcctgctggtgggtacccttgatgttgtgttggactccagcgcccgggtcgctccttaccgaatcttgtaccagactccagactccctggtctactggaccatcgcctgtggtggttccaggaaagaaatcactgaacactgggaatggcttgagcaaaatctcttgcagacactctccatctttgaaaatgagaatgatatcaccacatttgtgagaggaaaaatacagggcatcattgcagaatacaacaaaatcaatgatgtaaaggaagatgatgacacggagaagtttaaagaagccattgtgaaatttcataggctgtttgggatgccagaggaagagaaactcgtcaactattactcttgcagctattggaaggggaaggtcccccgtcagggttggatgtacctcagcattaaccacctttgcttttattcttttcttatgggaagggaagcgaaactggtcatccggtgggtagacatcactcagcttgagaagaatgccaccctgcttctgcctgatgtgatcaaagtgagcacacggtccagtgagcatttcttctctgtattcctcaacatcaacgagaccttcaagttaatggagcagcttgccaacatagccatgaggcaactcttagacaatgagggatttgaacaagatcgatccctgcccaaactcaaaaggaaatctcctaaaaaagtgtctgctctaaaacgtgatcttgatgccagggcaaagagtgagagataccgtgcacttttccggctgcccaaagatgaaaaattagatggccacacagactgcactctctggactccatttaacaaaatgcacattttggggcagatgtttgtgtccacaaattacatctgttttaccagcaaggaggagaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccatgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactcagatacagctttttatctttgtgcttgagttcctgcctaaggaataacattattcttttgacaacttttgcaggggaaattatatcaggcaaccattttgattaagtaaataaattttataggcaaacatatagagaganatacaatttgtagtatatcaatgactatatttaaaataaggantataattgttatcagttatctaacttaaaatgcttatccataatgatcagtgatattcagctttttaaaatatgcttgttgg

SEQ ID NO: 79 - protein, 183 aa, Homo Sapien
MRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 80 - protein, 909 aa, Homo Sapien
MAARPLPVSPARALLLALAGALLAPCEARGVSLWNEGRADEVVSASVRSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 81 - protein, 158 aa, Homo Sapien
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKRQQWQWIDGAMYLYRSWSGKSMGGNKHCAEISSNNNFLTWSSNECNKRQHFLCKYRP

SEQ ID NO: 82 - protein, 84 aa, Homo Sapien
MATMENKVICALVLVSMLALGTLAEAQTETCTVAPRERQNCGFPGVTPSQCANKGCCFDDTVRGVPWCFYPNTIDVPPEEECEF

SEQ ID NO: 83 - protein, 680 aa, Homo Sapien
MLPQIPFLLLVSLNLVHGVFYAERYQTPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGPPGVGKRGENGVPGQPGIKGDRGFPGEMGPIGPPGPQGPPGERGPEGIGKPGAAGAPGQPGIPGTKGLPGAPGIAGPPGPPGFGKPGLPGLKGERGPAGLPGGPGAKGEQGPAGLPGKPGLTGPPGNMGPQGPKGIPGSHGLPGPKGETGPAGPAGYPGAKGERGSPGSDGKPGYPGKPGLDGPKGNPGLPGPKGDPGVGGPPGLPGPVGPAGAKGMPGHNGEAGPRGAPGIPGTRGPIGPPGIPGFPGSKGDPGSPGPPGPAGIATKGLNGPTGPPGPPGPRGPSGEPGLPGPPGPPGPPGQAVMPEGFIKAGQRPSLSGTPLVSANQGVTGMPVSAFTVILSKAYPAIGTPIPFDKILYNRQQHYDPRTGIFTCQIPGIYYFSYHVHVKGTHVWVGLYKNGTPVMYTYDEYTKGYLDQASGSAIIDLTENDQVWLQLPNAESNGLYSSEYVHSSFSGFLVAPM

SEQ ID NO: 84 - protein, 542 aa, Homo Sapien
MPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 85 - protein, 553 aa, Homo Sapien
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 86 - protein, 95 aa, Homo Sapien
MAAARLCLSLLLLSTCVALLLQPLLGAQGAPLEPVYPGDNATPEQMAQYAADLRRYINMLTRPRYGKRHKEDTLAFSEWGSPHAAVPRELSPLDL

SEQ ID NO: 87 - protein, 344 aa, Homo Sapien
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDGPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 88 - protein, 987 aa, Homo Sapien
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 89 - protein, 911 aa, Homo Sapien
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEKSLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 90 - protein, 671 aa, Homo Sapien
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 91 - protein, 86 aa, Homo Sapien
MAVRQWVIALALAALLVVDREVPVAAGKLPFSRMPICEHMVESPTCSQMSNLVCGTDGLTYTNECQLCLARIKTKQDIQIMKDGKC

SEQ ID NO: 92 - protein, 459 aa, Homo Sapien
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFRYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 93 - protein, 375 aa, Homo Sapien
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 94 - protein, 260 aa, Homo Sapien
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 95 - protein, 1095 aa, Homo Sapien
MRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLTKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKHISERTIQDSNYGGKIPIVCFAQGGGKETLKAINTSIKNKIPCVVVEGSGRIADVIASLVEVEDAPTSSAVKEKLVRFLPRTVSRLSEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFTAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 96 - protein, 1095 aa, Homo Sapien
MRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 97 - protein, 347 aa, Homo Sapien
RRGRGEVLAVERGSGSGGGGTRSGWPAPAAGADKKPSRCGSGREGEGVSEGHKSMTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQRRPTDLDVDTLASLLSSNGCPDPDLVLKFGPVDSTLGFLPWHIRLTEIVSLPSHLNISYEDFFSALRQYAACEQRLGK

SEQ ID NO: 98 - protein, 293 aa, Homo Sapien
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQKRPTDLDVDTLASLLSSNGCPDPDLVLKFGPVDSTLGFLPWHIRLTEIVSLPSHLNISYEDFFSALRQYAACEQRLGK

SEQ ID NO: 99 - protein, 553 aa, Homo Sapien
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 100 - protein, 987 aa, Homo Sapien [sequence omitted]

SEQ ID NO: 101 - protein, 986 aa, Homo Sapien
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 102 - protein, 153 aa, Homo Sapien
MNFSTSSSSFAYDREFLRTLPGFLIVAEIVLGLLVWTLIAGTEYFRVPAFGWVMFVAVFYWVLTVFFLIIYITMTYTRIPQVPWTTVGLCFNGSAFVLYLSAAVVDASSVSPERDSHNFNSWAASSFFAFLVNICYAGNTYFSFIAWRSRTIQ

SEQ ID NO: 103 - protein, 153 aa, Homo Sapien
MNFSTSSSSFAYDREFLRTLPGFLIVAEIVLGLLVWTLIAGTEYFRVPAFGWVMFVAVFYWVLTVFFLIIYITMTYTRIPQVPWTTVGLCFNGSAFVLYLSAAVVDASSVSPERDSHNFNSWAASSFFAFLVTICYAGNTYFSFIAWRSRTIQ

SEQ ID NO: 104 - protein, 555 aa, Homo Sapien
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVALPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRPRKNKEKMIYLQVQKLDIPLN

SEQ ID NO: 105 - protein, 555 aa, Homo Sapien
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVSLPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRPRKNKEKMIYLQVQKLDIPLN

SEQ ID NO: 106 - protein, 690 aa, Homo Sapien
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCYCCRVCCRACCLLCGCPKCCRCSKCCEDLEEAQEGQDVPVKAPETFDNITISREAQGEVPASDSKTECTAL

SEQ ID NO: 107 - protein, 690 aa, Homo Sapien
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCGCPKCCRCSKCCEDLEEAQEGQDVPVKAPETFDNITISREAQGEVPASDSKTECTAL

SEQ ID NO: 108 - protein, 411 aa, Homo Sapien [sequence omitted]

SEQ ID NO: 109 - protein, 320 aa, Homo Sapien
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 110 - protein, 2314 aa, Homo Sapien
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 111 - protein, 774 aa, Homo Sapien
MCARMAGRTRAAPRGPYGPWLCLLVALALDVVRVDCGQAPLDPVYLHVTAARPAQPTLWTAKLDRFKGSRHHTTLITCHRAGLTEPDSSSPLELSEFLWVDFVVENSTGGGVAVTRPVTWQLEYPGQAPEAEKDKMVWEILVSERDIRALIPLAKAEELVNTAPLTGVPQHVPVRLVTVDGGGALVEVTEHVGCESANTQVLQVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFVPAPPAQSPEEPVGAPAVQSILVAGEEDIRWVCEDMGLKDPEELRNYMERIRGSS

SEQ ID NO: 112 - protein, 420 aa, Homo Sapien
MATKTELSPTARESKNAQDMQVDETLIPRKGPSLCSARYGIALVLHFCNFTTIAQNVIMNITMVAMVNSTSPQSQLNDSSEVLPVDSFGGLSKAPKSLPAKSSILGGQFAIWEKWGPPQERSRLCSIALSGMLLGCFTAILIGGFISETLGWPFVFYIFGGVGCVCCLLWFVVIYDDPFSYPWISTSEKEYIISSLKQQVGSSKQPLPIKAMLRSLPIWSICLGCFSHQWLVSTMVVYIPTYISSVYHVNIRDNGLLSALPFIVAWVIGMVGGYLADFLLTKKFRLITVRKIATILGSLPSSALIVSLPYLNSGYITATALLTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 113 - protein, 401 aa, Homo Sapien
MQVDETLIPRKVPSLCSARYGIALVLHFCNFTTIAQNVIMNITMVAMVNSTSPQSQLNDSSEVLPVDSFGGLSKAPKSLPTKSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVRSSKQPLPIKAMLRSLPIWSICLGCFSHQWLVSTMVVYIPTYISSVYHVNIRDNGLLSALPFIVAWVIGMVGGYLADFLLTKKFRLITVRKIATILGSLPSSALIVSLPYLNSGYITATALLTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 114 - protein, 507 aa, Homo Sapien
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPKFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 115 - protein, 507 aa, Homo Sapien
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 116 - protein, 622 aa, Homo Sapien
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQEALSGTPCLLGPGPVLTVLALLLASTLA

SEQ ID NO: 117 - protein, 621 aa, Homo Sapien
ALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQEALSGTPCLLGPGPVLTVLALLLASTLA

SEQ ID NO: 118 - protein, 357 aa, Homo Sapien
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 119 - protein, 836 aa, Homo Sapien
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERFMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMVQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 120 - protein, 809 aa, Homo Sapien
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 121 - protein, 751 aa, Homo Sapien
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYKPIIKKYTKIIDGVPVEITEKETREERIITGPEIKYTRISTGGGETEETLKKLLQEDTPVRKLQANKKVQGSRRRLREGRSQ

SEQ ID NO: 122 - protein, 781 aa, Homo Sapien
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEDTPVRKLQANKKVQGSRRRLREGRSQ

SEQ ID NO: 123 - protein, 779 aa, Homo Sapien
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYKPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 124 - protein, 283 aa, Homo Sapien
MVNYAWAGRSQRKLWWRSVAVLTCKSVVRPGYRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 125 - protein, 254 aa, Homo Sapien
MPGQGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 126 - protein, 539 aa, Homo Sapien
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQVPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 127 - protein, 1325 aa, Homo Sapien
MLPVYQEVKPNPLQDANICSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFKEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 128 - protein, 501 aa, Homo Sapien
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKSRQTPEGEFLPLDQLELDVGFSTGADQLFLVSPLTICHVIDAKSPFYDLSQRSMQTEQFEIVVILEGIVETTGMTCQARTSYTEDEVLWGHRFFPVISLEEGFFKVDYSQFHATFEVPTPPYSVKEQEEMLLMSSPLIAPAITNSKERHNSVECLDGLDDITTKLPSKLQKITGREDFPKKLLRMSSTTSEKAYSLGDLPMKLQRISSVPGNSEEKLVSKTTKMLSDPMSQSVADLPPKLQKMAGGAARMEGNLPAKLRKMNSDRFT

SEQ ID NO: 129 - protein, 1148 aa, Homo Sapien
MPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYPNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVIFIGLAGLLGLITCLICGVLVTTRRRKKEGEYNVQQQCPGYYQSHLDLEDLQ

SEQ ID NO: 130 - protein, 564 aa, Homo Sapien
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSVAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 131 - protein, 564 aa, Homo Sapien
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 132 - protein, 294 aa, Homo Sapien
MGNWVVNHWFSVLFLVVWLGLNVFLFVDAFLKYEKADKYYYTRKILGSWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 133 - protein, 515 aa, Homo Sapien
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 134 - protein, 757 aa, Homo Sapien
MTSGSVFFYILIFGKYFSHGGGQDVKCSLGYFPCGNITKCLPQLLHCNGVDDCGNQADEDNCGDNNGWSMQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 135 - protein, 757 aa, Homo Sapien
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 136 - protein, 879 aa, Homo Sapien [sequence omitted]

SEQ ID NO: 137 - protein, 434 aa, Homo Sapien
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQVLVILMDVFTDVEIFCDILEAANKRGVFVCVLLDQGGVKLFQEMCDKVQISDSHLKNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPGTRSVSASSGPCSPAAPHPPPPPRFQPHQGPWGAPSPQAHLSPRPHDGPPAAVYSNLGAYRPTRLQLEQLGLVPRLTPTWRPFLQASPHF

SEQ ID NO: 138 - protein, 933 aa, Homo Sapien
MALPQPPPPAGARDPVTPEHWASGPPSQAQPLLRQEAKEEEEGEETGVQGAWGTGTAEQRRRGWGEAAESAAAEEGQAEVGGAAAAGSGSPAGGAGGGLGSWRPLLAWLQRRQPQCCPCAAPLSRSAAHCCHGGTKMAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETTAMILMNVYCNKILKPVDGSCCQPRPPVTLIQKLAACFFTLSIIGYLIFYIIHRNAHRKNKPCTDLESGEEKKNIINTPVSSLEILLQSFCKLGLIMAYFYMCDRANLFMKENKFYTHSSFFIPIIYILVLGVFYNENTKETKVLNREQTDEWKGWMQLVILIYHISGASTFLPVYMHIRVLVAAYLFQTGYGHFSYFWIKGDFGIYRVCQVLFRLNFLVVVLCIVMDRPYQFYYFVPLVTVWFMVIYVTLALWPQIIQKKANGNCFWHFGLLLKLGFLLLFICFLAYSQGAFEKIFSLWPLSKCFELKGNVYEWWFRWRLDRYVVFHGMLFAFIYLALQKRQILSEGKGEPLFSNKISNFLLFISVVSFLTYSIWASSCKNKAECNELHPSVSVVQILAFILIRNIPGYARSVYSSFFAWFGKISLELFICQYHIWLAADTRGILVLIPGNPMLNIIVSTFIFVCVAHEISQITNDLAQIIIPKDNSSLLKRLACIAAFFCGLLILSSIQDKSKH

SEQ ID NO: 139 - protein, 320 aa, Homo Sapien
MYHCHSGSKPTEKGANEYAYAKWKLCSASAICFIFMIAEVVGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 140 - protein, 426 aa, Homo Sapien
MVLSVPVIALGATLGTATSILALCGVTCLCRHMHPKKGLLPRDQDPDLEKAKPSLLGSAQQFNVKKSTEPVQPRALLKFPDIYGPRPAVTAPEVINYADYSLRSTEEPTAPASPQPPNDSRLKRQVTEELFILPQNGVVEDVCVMETWNPEKAASWNQAPKLHYCLDYDCQKAELFVTRLEAVTSNHDGGCDCYVQGSVANRTGSVEAQTALKKRQLHTTWEEGLVLPLAEEELPTATLTLTLRTCDRFSRHSVAGELRLGLDGTSVPLGAAQWGELKTSAKEPSAGAGEVLLSISYLPAANRLLVVLIKAKNLHSNQSKELLGKDVSVKVTLKHQARKLKKKQTKRAKHKINPVWNEMIMFELPDDLLQASSVELEVLGQDDSGQSCALGHCSLGLHTSGSERSHWEEMLKNPRRQIAMWHQLHL

SEQ ID NO: 141 - protein, 883 aa, Homo Sapien
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLEFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMRQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLGTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 142 - protein, 357 aa, Homo Sapien; identical to SEQ ID NO: 118

SEQ ID NO: 143 - protein, 222 aa, Homo Sapien
MLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 144 - protein, 236 aa, Homo Sapien
MPGAAAAAAAAAAAMLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 145 - protein, 236 aa, Homo Sapien; identical to SEQ ID NO: 144

SEQ ID NO: 146 - protein, 408 aa, Homo Sapien
RPLRLPCRGPRAAGTVSSESLGHPAPGQVTNRSPQFPMELFQSSPRPPLQPVCVCPGLELCDPPHRLAFSMGAGLFSVVGTLLLPGLAALVQDWRLLQGLGALMSGLLLLFWGFPALFPESPCWLLATGQVARARKILWRFAEASGVGPGDSSLEENSLATELTMLSARSPQPRYHSPLGLLRTRVTWRNGLILGFSSLVGGGIRASFRRSLAPQVPTFYLPYFLEAGLEAAALVFLLLTADCCGRRPVLLLGTMVTGLASLLLLAGAQYLPGWTVLFLSVLGLLASRAVSALSSLFAAEVFPTVIRGAGLGLVLGAGFLGQAAGPLDTLHGRQGFFLQQVVFASLAVLALLCVLLLPESRSRGLPQSLQDADRLRRSPLLRGRPRQDHLPLLPPSNSYWAGHTPEQH

SEQ ID NO: 147 - protein, 1152 aa, Homo Sapien
  unsure 382: unknown amino acid
MPFEQCHLSWKNVRRLYNAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSXIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 148 - protein, 1143 aa, Homo Sapien
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 149 - protein, 384 aa, Homo Sapien
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 150 - protein, 327 aa, Homo Sapien
MVRCDRGLQMLLTTAGAFAAFSLMAIAIGTDYWLYSSAHICNGTNLTMDDGPPPRRARGDLTHSGLWRVCCIEGIYKGHCFRINHFPEDNDYDHDSSEYLLRIVRASSVFPILSTILLLLGGLCIGAGRIYSRKNNIVLSAGILFVAAGLSNIIGIIVYISSNTGDPSDKRDEDKKNHYNYGWSFYFGALSFIVAETVGVLAVNIYIEKNKELRFKTKREFLKASSSSPYARMPSYRYRRRRSRSSSRSTEASPSRDVSPMGLKITGAIPMGELSMYTLSREPLKVTTAASYSPDQEASFLQVHDFFQQDLKEGFHVSMLNRRTTPV

SEQ ID NO: 151 - protein, 323 aa, Homo Sapien
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGEVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 152 - protein, 207 aa, Homo Sapien
MGKCSGRCTLVAFCCLQLVAALERQIFDFLGYQWAPILANFLHIMAVILGIFGTVQYRSRYLILYAAWLVLWVGWNAFIICFYLEVGQLSQDRDFIMTFNTSLHRSWWMENGPGCLVTPVLNSRLALEDHHVISVTGCLLDYPYIEALSSALQIFLALFGFVFACYVSKVFLEEEDSFDFIGGFDSYGYQAPQKTSHLQLQPLYTSG

SEQ ID NO: 153 - protein, 581 aa, Homo Sapien
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 154 - protein, 1266 aa, Homo Sapien
MWVNPEEVLLANALWITERANPYFILQRRKGHAGDGGGGGGLAGLLVGTLDVVLDSSARVAPYRILYQTPDSLVYWTIACGGSRKEITEHWEWLEQNLLQTLSIFENENDITTFVRGKIQGIIAEYNKINDVKEDDDTEKFKEAIVKFHRLFGMPEEEKLVNYYSCSYWKGKVPRQGWMYLSINHLCFYSFLMGREAKLVIRWVDITQLEKNATLLLPDVIKVSTRSSEHFFSVFLNINETFKLMEQLANIAMRQLLDNEGFEQDRSLPKLKRKSPKKVSALKRDLDARAKSERYRALFRLPKDEKLDGHTDCTLWTPFNKMHILGQMFVSTNYICFTSKEENLCSLIIPLREVTIVEKADSSSVLPSPLSISTRNRMTFLFANLKDRDFLVQRISDFLQQTTSKIYSDKEFAGSYNSSDDEVYSRPSSLVSSSPQRSTSSDADGERQFNLNGNSVPTATQTLMTMYRRRSPEEFNPKLAKEFLKEQAWKIHFAEYGQGICMYRTEKTRELVLKGIPESMRGELWLLLSGAINEKATHPGYYEDLVEKSMGKYNLATEEIERDLHRSLPEHPAFQNEMGIAALRRVLTAYAFRNPNIGYCQAMNIVTSVLLLYAKEEEAFWLLVALCERMLPDYYNTRVVGALVDQGVFEELARDYVPQLYDCMQDLGVISTISLSWFLTLFLSVMPFESAVVVVDCFFYEGIKVIFQLALAVLDANVDKLLNCKDDGEAMTVLGRYLDSVTNKDSTLPPIPHLHSLLSDDVEPYPEVDIFRLIRTSYEKFGTIRADLIEQMRFKQRLKVIQTLEDTTKRNVVRTIVTETSFTIDELEELYALFKAEHLTSCYWGGSSNALDRHDPSLPYLEQYRIDFEQFKGMFALLFPWACGTHSDVLASRLFQLLDENGDSLINFREFVSGLSAACHGDLTEKLKLLYKMHVLPEPSSDQDEPDSAFEATQYFFEDITPECTHVVGLDSRSKQGADDGFVTVSLKPDKGKRANSQENRNYLRLWTPENKSKSKNAKDLPKLNQGQFIELCKTMYNMFSEDPNEQELYHATAAVTSLLLEIGEVGKLFVAQPAKEGGSGGSGPSCHQGIPGVLFPKKGPGQPYVVESVEPLPASLAPDSEEHSLGGQMEDIKLEDSSPRDNGACSSMLISDDDTKDDSSMSSYSVLSAGSHEEDKLHCEDIGEDTVLVRSGQGTAALPRSTSLDRDWAITFEQFLASLLTEPALVKYFDKPVCMMARITSAKNIRMMGKPLTSASDYEISAMSG

What is claimed is:

1. An isolated polypeptide comprising:
 (a) amino acids 1-411 of SEQ ID NO:108;
 (b) amino acids 17-411 of SEQ ID NO:108;
 (c) amino acids 1-391 of SEQ ID NO:108; or
 (d) amino acids 17-391 of SEQ ID NO:108.

2. A chimeric polypeptide comprising the polypeptide of claim 1 fused to a heterologous polypeptide.

3. The chimeric polypeptide of claim 2, wherein said heterologous polypeptide is an epitope tag sequence or an Fc region of an immunoglobulin.

* * * * *